United States Patent 11,931,406 (FLAVIVIRUS VACCINE) - sequence listing, part 2

SEQ ID NO: 1440 - RNA, 2031 nt, Artificial Sequence
  derived and/or modified CDS sequence (opt1) from DENV-1 CYD23__SSc-prME
augagcgugaccaugcugcucaugcugaugcccaccgcccuggccuuccaccucacgacccgcggcggggagccccacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccaccaccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgugagcuggaccaugaagaucgggaucggcgugcugcugacguggcucggccugaacucccgcagcaccucccugagcaugaccugcaucgccguggggcucgucacccuguaccugggcgugauggugcaggccuga

SEQ ID NO: 1441 - RNA, 2031 nt, Artificial Sequence
  derived and/or modified CDS sequence (opt1) from DENV-1 CYD23__SSc-prME(F108S)
augagcgugaccaugcugcucaugcugaugcccaccgcccuggccuuccaccucacgacccgcggcggggagccccacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguccggcaaggggagccucaucacgugcgccaaguucaagugcgugaccaagcuggagggcaagaucguccaguacgagaaccugaaguacuccgugaucgugaccguccacaccggcgaccagcaccagguggggaacgagagcacggagcacggcaccaccgcgaccaucacgccccaggcccccaccaccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccuccaccagccaggagacguggaaccggcaggaccugcuggugaccuucaagaccgcccacgcgaagaagcaggaggucguggugcucggcucccaggagggcgccaugcacaccgcccugacgggggccaccgagauccagaccagcggcaccacgaccaucuucgccgggcaccugaagugccgccucaagauggacaagcugacccugaagggcauguccuacgucaugugcaccgggagcuucaagcucgagaaggagguggcggagacgcagcacggcaccgugcugguccagaucaaguacgagggcaccgacgcccccugcaagauccccuucuccacccaggacgagaagggggugacgcagaacggccggcugaucaccgccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucgaggccaccgcccgcggggcccggcgcauggcgauccugggcgacacggccugggacuucgggagcaucggcggcguguucaccuccgucgggaagcuggugcaccagaucuucggcaccgccuacgggguccucuucagcggcguguccuggaccaugaagaucgggaucggcgugcugcugacguggcucggccugaacagccgcuccaccagccuguccaugaccugcaucgccguggggcucgucacccuguaccugggcgugauggugcaggccuga

SEQ ID NO: 1442 - RNA, 2031 nt, Artificial Sequence
  derived and/or modified CDS sequence (opt1) from DENV-1 CYD23__SSc-prMEdelstem_TM-JEV
augagcgugaccaugcugcucaugcugaugcccaccgcccuggccuuccaccucacgacccgcggcggggagccccacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaaccccgcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccaccaccgagauccagcucaccgacuacggggcccugacccuggacugcagcccccgcacgggccucgacuucaacgagaugguccugcugaccaugaaggagaaguccuggcucgugcacaagcagugguuccuggaccugccgcuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccugaagcucagcugguucaagaagggguccacccugggcaaggccuucagcacgacccugaagggggcccagcgccucgccgcgcugggcgacaccgccugggacuucggguccaucggcggcguguucaacagcaucgggcgggccguccaccagguguucggcggggccuuccgcacccuguucggcgggauguccuggaucacgcagggccucaugggcgcccugcugcucuggaugggggugaacgcgcgcgaccggagcaucgcccuggccuuccuggccaccggcgggguccucguguuccuggccaccaacgugcacgcguga

SEQ ID NO: 1443 - RNA, 2379 nt, Artificial Sequence
  derived and/or modified CDS sequence (opt1) from DENV-1 CYD23__C-P2A-SSc-prME
augaacaaccagcgcaagaagaccgcccggcccagcuucaacaugcugaagcgcgcccggaaccgcguguccaccgucagccagcucgcgaagcgguucuccaagggccugcugagcgggcagggcccgaugaagcucgugauggccuucaucgccuuccugcgcuuccuggccaucccgcccacggccgggauccucgcgcgguggggcuccuucaagaagaacggggccaucaaggugcugcgcggcuucaagaaggagaucagcaacaugcugaacaucaugaaccggcgccggaagaacuucgaccuccugaagcuggccggcgacgucgaguccaaccccgggcccagcgugaccaugcuccugaugcugaugcccaccgcccucgcguuccaccugaccacgcgcggcggggagccccacaugaucguguccaagcaggagcggggcaagagccuccucuucaagaccuccgccggggucaacaugugcacccugaucgccauggaccugggcgagcucugcgaggacaccaugacguacaagugcccccgcaucaccgaggccgagccggacgacguggacugcuggugcaacgccaccgacaccugggugacguacgggaccugcagccagaccggggagcaccggcgcgacaagcgguccgucgcgcuggcgccccacgugggccuggggcucgagacccgcacggagaccuggaugagcuccgagggcgccuggaagcagauccagcggguggagaccugggcccugcgccaccccggcuucaccgucaucgcccuguuccucgcccacgccaucgggacgagcaucacccagaagggcaucaucuucauccugcugaugcucgugacccccuccauggccaugcggugcguggggaucggcagccgcgacuucgucgaggggcuguccggcgccaccuggguggacgugguccuggagcacggcagcugcgugacgaccauggccaaggacaagccgacccucgacaucgagcugcugaagaccgaggugacgaaccccgcgguccuccgcaagcugugcaucgaggccaagaucagcaacaccaccaccgacucccggugccccacgcagggggaggccacccugguggaggagcaggacgccaacuucgugugccgccggaccuucgucgaccgcggcugggggaacggcugcgggcuguucggcaagggcagccugcugaccugcgccaaguucaagugcgugacgaagcucgaggggaagaucguccaguacgagaaccugaaguacuccgugaucgugaccguccacaccggcgaccagcaccagguggggaacgagagcaccgagcacggcaccacggcgaccaucacgccccaggccccgaccaccgagauccagcugaccgacuacggggcccucacccuggacugcagcccccggaccggccuggacuucaacgagauggugcuccugacgaugaaggagaaguccuggcugguccacaagcagugguuccuggaccucccccugcccuggaccuccggcgccagcaccucccaggagaccuggaaccgccaggaccugcucgugacguucaagaccgcgcacgccaagaagcaggagguggucgugcuggggagccaggagggcgccaugcacaccgcccugaccggggccacggagauccagaccuccggcaccaccacgaucuucgcgggccaccucaagugccggcugaagauggacaagcugacccucaaggggaugagcuacgugaugugcaccggcuccuucaagcuggagaaggaggucgccgagacccagcacgggacggugcuggugcagaucaaguacgagggcaccgacgccccgugcaagauccccuucagcacccaggacgagaagggggucacccagaacggccgccucaucacggccaaccccaucgugaccgacaaggagaagcccgugaacaucgaggccgagccgcccuucggcgaguccuacaucgucaucggggcgggcgagaaggcccugaagcugagcugguucaagaagggguccagcaucggcaagauguucgaggccaccgcccggggcgcccgccggauggcgauccucggcgacaccgccugggacuucggcuccaucgggggcguguucacgagcguggggaagcugguccaccagaucuucggcaccgccuacggggugcuguucagcggcguguccuggaccaugaagaucggcaucgggguccuccugaccuggcugggccucaacagccgcuccacgagccuguccaugaccugcaucgccguggggcuggugacccucuaccugggcgucauggugcaggcguga

SEQ ID NO: 1444 - RNA, 2043 nt, Artificial Sequence
  derived and/or modified CDS sequence (opt1) from DENV-1 CYD23__SSopt-prME(F108S)
augaagcgcaagaaguccgugaccaugcugcucaugcugaugcccaccgcccuggccuuccaccucacgacccggggcggggagccccacaugaucgucuccaagcaggagcgcggcaagagccugcuguucaagaccuccgcgggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccgccgggacaagcgcuccguggcccucgcgccccacgugggccuggggcuggagacgcggaccgagaccuggaugagcuccgagggcgccuggaagcagauccagcgcgucgagaccugggcccuccggcacccgggguucacggugaucgcccuguuccuggcgcacgccaucggcaccagcaucacccagaaggggaucaucuucauccuccugaugcuggugacccccuccauggccaugcgcugcgucggcaucggcagccgggacuucguggaggggcucuccggcgccacguggguggacgucgugcuggagcacgggagcugcgugaccaccauggccaaggacaagcccacccuggacaucgagcuccugaagacggaggucaccaaccccgcggugcugcgcaagcucugcaucgaggccaagaucuccaacaccaccacggacagccggugcccgacccagggcgaggccacccugguggaggagcaggacgccaacuucgucugccgccggaccuucguggaccgcggcugggggaacggcugcgggcuguccggcaaggggagccucaucacgugcgccaaguucaagugcgugaccaagcuggagggcaagaucguccaguacgagaaccugaaguacuccgugaucgugaccguccacaccggcgaccagcaccagguggggaacgagagcacggagcacggcaccaccgcgaccaucacgccccaggcccccaccaccgagauccagcucaccgacuacggggcccugacccuggacugcagcccccggacgggccucgacuucaacgagaugguccugcugaccaugaaggagaaguccuggcucgugcacaagcagugguuccuggaccugccgcuccccuggaccagcggggccagcaccagccaggagacguggaaccgccaggaccugcuggugaccuucaagaccgcccacgcgaagaagcaggaggucguggugcucggcucccaggagggcgccaugcacaccgcccugacgggggccaccgagauccagaccagcggcaccacgaccaucuucgccgggcaccugaagugccggcucaagauggacaagcugacccugaagggcauguccuacgucaugugcaccgggagcuucaagcucgagaaggagguggcggagacgcagcacggcaccgugcugguccagaucaaguacgagggcaccgacgcccccugcaagauccccuucuccacccaggacgagaagggggugacgcagaacggccgccugaucaccgccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucgaggccaccgcccgcggggcccggcgcauggcgauccugggcgacacggccugggacuucgggagcaucggcggcguguucaccuccgucgggaagcuggugcaccagaucuucggcaccgccuacgggguccucuucagcggcguguccuggaccaugaagaucgggaucggcgugcugcugacguggcucggccugaacagccgguccaccagccuguccaugaccugcaucgccguggggcucgucacccuguaccugggcgugauggugcaggccuga

SEQ ID NO: 1445 - RNA, 2043 nt, Artificial Sequence
  derived and/or modified CDS sequence (opt1) from DENV-1 CYD23__SSopt-prME(F96H)
augaagcgcaagaaguccgugaccaugcugcucaugcugaugcccaccgcccuggccuuccaccucacgacccggggcggggagccccacaugaucgucagcaagcaggagcgcggcaagagccugcuguucaagaccuccgcgggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccgccgggacaagcgcuccguggcccucgcgccccacgugggccuggggcuggagacgcggaccgagaccuggaugagcuccgagggcgccuggaagcagauccagcgcgucgagaccugggcccuccggcacccgggguucacggugaucgcccuguuccuggcgcacgccaucggcaccagcaucacccagaaggggaucaucuucauccuccugaugcuggugacccccuccauggccaugcgcugcgucggcaucggcagccgggacuucguggaggggcucuccggcgccacguggguggacgucgugcuggagcacgggagcugcgugaccaccauggccaaggacaagcccacccuggacaucgagcuccugaagacggaggucaccaaccccgcggugcugcgcaagcucugcaucgaggccaagaucuccaacaccaccacggacagccggugcccgacccagggcgaggccacccugguggaggagcaggacgccaacuucgucugccgccggacccacguggaccgcggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccaccaccgagauccagcucaccgacuacggggcccugacccuggacugcagcccccggacgggccucgacuucaacgagaugguccugcugaccaugaaggagaaguccuggcucgugcacaagcagugguuccuggaccugccgcuccccuggaccagcggggccagcaccucccaggagacguggaaccgccaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccggcucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccgccugaucaccgccaacccgaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacgggguccucuucuccggcgugagcuggaccaugaagaucgggaucggcgugcugcugacguggcucggccugaacucccggagcaccucccugagcaugaccugcaucgccguggggcucgucacccuguaccugggcgugauggugcaggccuga

SEQ ID NO: 1446 - RNA, 2043 nt, Artificial Sequence
  derived and/or modified CDS sequence (opt1) from DENV-1 CYD23__SSopt-prME(S186F)
augaagcgcaagaaguccgugaccaugcugcucaugcugaugcccaccgcccuggccuuccaccucacgacccggggcggggagccccacaugaucgucagcaagcaggagcgcggcaagagccugcuguucaagaccuccgcgggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccgccgggacaagcgcuccguggcccucgcgccccacgugggccuggggcuggagacgcggaccgagaccuggaugagcuccgagggcgccuggaagcagauccagcgcgucgagaccugggcccuccggcacccgggguucacggugaucgcccuguuccuggcgcacgccaucggcaccagcaucacccagaaggggaucaucuucauccuccugaugcuggugacccccuccauggccaugcgcugcgucggcaucggcagccgggacuucguggaggggcucuccggcgccacguggguggacgucgugcuggagcacgggagcugcgugaccaccauggccaaggacaagcccacccuggacaucgagcuccugaagacggaggucaccaaccccgcggugcugcgcaagcucugcaucgaggccaagaucuccaacaccaccacggacagccggugcccgacccagggcgaggccacccugguggaggagcaggacgccaacuucgucugccgccggaccuucguggaccgcggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccaccaccgagauccagcucaccgacuacggggcccugacccuggacugcuucccccggacgggccucgacuucaacgagaugguccugcugaccaugaaggagaaguccuggcucgugcacaagcagugguuccuggaccugccgcuccccuggaccagcggggccagcaccagccaggagacguggaaccgccaggaccugcuggugaccuucaagaccgcccacgcgaagaagcaggaggucguggugcucggcucccaggagggcgccaugcacaccgcccugacgggggccaccgagauccagaccagcggcaccacgaccaucuucgccgggcaccugaagugccggcucaagauggacaagcugacccugaagggcauguccuacgucaugugcaccgggagcuucaagcucgagaaggagguggcggagacgcagcacggcaccgugcugguccagaucaaguacgagggcaccgacgcccccugcaagauccccuucuccacccaggacgagaagggggugacgcagaacggccgccugaucaccgccaacccgaucgugaccgacaaggagaagcccgucaacaucgaggccgagccgcccuucggggagagcuacaucgugaucggcgcgggcgagaaggcccugaagcucuccugguucaagaaggggagcuccaucggcaagauguucgaggccaccgcccgcggggcccggcgcauggcgauccugggcgacacggccugggacuucgggagcaucggcggcguguucaccuccgucgggaagcuggugcaccagaucuucggcaccgccuacgggguccucuucagcggcguguccuggaccaugaagaucgggaucggcgugcugcugacguggcucggccugaacagccgguccaccagccuguccaugaccugcaucgccguggggcucgucacccuguaccugggcgugauggugcaggccuga

SEQ ID NO: 1447 - RNA, 2043 nt, Artificial Sequence
  derived and/or modified CDS sequence (opt1) from DENV-1 CYD23__SSopt-prME(R188L)
augaagcgcaagaaguccgugaccaugcugcucaugcugaugcccaccgcccuggccuuccaccucacgacccggggcggggagccccacaugaucgucagcaagcaggagcgcggcaagagccugcuguucaagaccuccgcgggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccgccgggacaagcgcuccguggcccucgcgccccacgugggccuggggcuggagacgcggaccgagaccuggaugagcuccgagggcgccuggaagcagauccagcgcgucgagaccugggcccuccggcacccgggguucacggugaucgcccuguuccuggcgcacgccaucggcaccagcaucacccagaaggggaucaucuucauccuccugaugcuggugacccccuccauggccaugcgcugcgucggcaucggcagccgggacuucguggaggggcucuccggcgccacguggguggacgucgugcuggagcacgggagcugcgugaccaccauggccaaggacaagcccacccuggacaucgagcuccugaagacggaggucaccaaccccgcggugcugcgcaagcucugcaucgaggccaagaucuccaacaccaccacggacagccggugcccgacccagggcgaggccacccugguggaggagcaggacgccaacuucgucugccgccggaccuucguggaccgcggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccaccaccgagauccagcucaccgacuacggggcccugacccuggacugcagcccccucacgggccuggacuucaacgagaugguccugcucaccaugaaggagaaguccuggcuggugcacaagcagugguuccuggaccucccgcugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacgggggccaccgagauccagaccuccggcaccacgaccaucuucgccgggcaccucaagugccgccugaagauggacaagcugacccucaagggcaugagcuacgucaugugcaccggguccuucaagcuggagaaggagguggcggagacgcagcacggcaccgugcugguccagaucaaguacgagggcaccgacgcccccugcaagauccccuucagcacccaggacgagaagggggugacgcagaacggccggcugaucaccgccaacccgaucgugaccgacaaggagaagcccgucaacaucgaggccgagccgcccuucggggaguccuacaucgugaucggcgcgggcgagaaggcccucaagcugagcugguucaagaagggguccagcaucggcaagauguucgaggccaccgcccgcggggcccggcgcauggcgauccugggcgacacggccugggacuucggguccaucggcggcguguucaccagcgucgggaagcucgugcaccagaucuucggcaccgccuacggggugcuguucuccggcgucagcuggaccaugaagaucgggaucggcgugcugcucacguggcugggccugaacucccgcagcaccucccucagcaugaccugcaucgccguggggcuggucacccuguaccucggcgugauggugcaggccuga

SEQ ID NO: 1448 - RNA, 2043 nt, Artificial Sequence
  derived and/or modified CDS sequence (opt1) from DENV-1 CYD23__SSopt-pr(D104A)MEdelstem_TM,(F108S)-JEV
augaagcgcaagaaguccgugaccaugcugcucaugcugaugcccaccgcccuggccuuccaccucacgacccggggcggggagccccacaugaucgucuccaagcaggagcgcggcaagagccugcuguucaagaccuccgcgggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccgccgggccaagcgcuccguggcgcucgcgccccacgugggccuggggcuggagacgcggaccgagaccuggaugagcuccgagggcgccuggaagcagauccagcgcgucgagaccugggcccuccggcacccgggguucacggugaucgcccuguuccuggcccacgccaucggcaccagcaucacccagaaggggaucaucuucauccuccugaugcuggugacccccuccauggccaugcgcugcgucggcaucggcagccgggacuucguggaggggcucuccggcgccacguggguggacgucgugcuggagcacgggagcugcgugaccaccauggcgaaggacaagcccacccuggacaucgagcuccugaagacggaggucaccaaccccgccgugcugcgcaagcucugcaucgaggccaagaucuccaacaccaccacggacagccggugcccgacccagggcgaggccacccugguggaggagcaggacgccaacuucgucugccgccggaccuucguggaccgcggcugggggaacggcugcgggcuguccggcaaggggagccucaucacgugcgcgaaguucaagugcgugaccaagcuggagggcaagaucguccaguacgagaaccugaaguacuccgugaucgugaccguccacaccggcgaccagcaccagguggggaacgagagcacggagcacggcaccaccgccaccaucacgccccaggcccccaccaccgagauccagcucaccgacuacggggcccugacccuggacugcagcccccggacgggccucgacuucaacgagaugguccugcugaccaugaaggagaaguccuggcucgugcacaagcagugguuccuggaccugccgcuccccuggaccagcggggccagcaccagccaggagacguggaaccgccaggaccugcuggugaccuucaagaccgcgcacgccaagaagcaggaggucguggugcucggcucccaggagggcgccaugcacaccgcccugacgggggccaccgagauccagaccagcggcaccacgaccaucuucgcggggcaccugaagugccggcucaagauggacaagcugacccugaagggcauguccuacgucaugugcaccgggagcuucaagcucgagaaggagguggccgagacgcagcacggcaccgugcugguccagaucaaguacgagggcaccgacgcccccugcaagauccccuucuccacccaggacgagaagggggugacgcagaacggccgccugaucaccgccaacccgaucgugaccgacaaggagaagcccgucaacaucgaggcggagccgcccuucggggagagcuacaucgugaucggcgccggcgagaaggcccugaagcucuccugguucaagaaggggagcacccugggcaaggccuucuccacgacccugaagggggcccagcggcucgcggcccugggcgacaccgccugggacuucgggagcaucggcggcguguucaacuccaucgggcgcgccguccaccagguguucggcggggccuuccgcacccuguucggcgggaugagcuggaucacgcagggccucaugggcgcgcugcugcucuggaugggggugaacgcccgggaccgcuccaucgcccuggccuuccuggccaccggcgggguccucguguuccuggcgaccaacgugcacgccuga

SEQ ID NO: 1449 - RNA, 2043 nt, Artificial Sequence
  derived and/or modified CDS sequence (opt1) from DENV-1 CYD23__SSopt-prMEdelstem_TM,(H261N)-JEV
augaagcgcaagaaguccgugaccaugcugcucaugcugaugcccaccgcccuggccuuccaccucacgacccggggcggggagccccacaugaucgucagcaagcaggagcgcggcaagagccugcuguucaagaccuccgcgggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccgccgggacaagcgcuccguggcccucgcgccccacgugggccuggggcuggagacgcggaccgagaccuggaugagcuccgagggcgccuggaagcagauccagcgcgucgagaccugggcccuccggcacccgggguucacggugaucgcccuguuccuggcgcacgccaucggcaccagcaucacccagaaggggaucaucuucauccuccugaugcuggugacccccuccauggccaugcgcugcgucggcaucggcagccgggacuucguggaggggcucuccggcgccacguggguggacgucgugcuggagcacgggagcugcgugaccaccauggccaaggacaagcccacccuggacaucgagcuccugaagacggaggucaccaaccccgcggugcugcgcaagcucugcaucgaggccaagaucuccaacaccaccacggacagccggugcccgacccagggcgaggccacccugguggaggagcaggacgccaacuucgucugccgccggaccuucguggaccgcggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccaccaccgagauccagcucaccgacuacggggcccugacccuggacugcagcccccggacgggccucgacuucaacgagaugguccugcugaccaugaaggagaaguccuggcucgugcacaagcagugguuccuggaccugccgcuccccuggaccagcggggccagcaccucccaggagacguggaaccgccaggaccugcuggugaccuucaagaccgcccacgcgaagaagcaggaggucguggugcucggcagccaggagggcgccaugaacaccgcccugacgggggccaccgagauccagaccuccggcaccacgaccaucuucgccgggcaccugaagugccggcucaagauggacaagcugacccugaagggcaugagcuacgucaugugcaccggguccuucaagcucgagaaggagguggcggagacgcagcacggcaccgugcugguccagaucaaguacgagggcaccgacgcccccugcaagauccccuucagcacccaggacgagaagggggugacgcagaacggccgccugaucaccgccaacccgaucgugaccgacaaggagaagcccgucaacaucgaggccgagccgcccuucggggaguccuacaucgugaucggcgcgggcgagaaggcccugaagcucagcugguucaagaagggguccacccugggcaaggccuucagcacgacccugaagggggcccagcggcucgccgcgcugggcgacaccgccugggacuucggguccaucggcggcguguucaacagcaucgggcgcgccguccaccagguguucggcggggccuuccgcacccuguucggcgggauguccuggaucacgcagggccucaugggcgcccugcugcucuggaugggggugaacgcgcgggaccgcagcaucgcccuggccuuccuggccaccggcgggguccucguguuccuggccaccaacgugcacgcguga

SEQ ID NO: 1450 - RNA, 2043 nt, Artificial Sequence
  derived and/or modified CDS sequence (opt1) from DENV-1 CYD23__SSopt-prMEdelstem_TM,(R188L,A267T)-JEV
augaagcgcaagaaguccgugaccaugcugcucaugcugaugcccaccgcccuggccuuccaccucacgacccggggcggggagccccacaugaucgucagcaagcaggagcgcggcaagagccugcuguucaagaccuccgcgggggugaacaugugcacccucaucgccauggaccugggcgagcugugcgaggacacgaugaccuacaagugcccccggaucaccgaggccgagcccgacgacguggacugcuggugcaacgccaccgacacgugggucaccuacgggaccugcagccagaccggcgagcaccgccgggacaagcgcuccguggcccucgcgccccacgugggccuggggcuggagacgcggaccgagaccuggaugagcuccgagggcgccuggaagcagauccagcgcgucgagaccugggcccuccggcacccgggguucacggugaucgcccuguuccuggcgcacgccaucggcaccagcaucacccagaaggggaucaucuucauccuccugaugcuggugacccccuccauggccaugcgcugcgucggcaucggcagccgggacuucguggaggggcucuccggcgccacguggguggacgucgugcuggagcacgggagcugcgugaccaccauggccaaggacaagcccacccuggacaucgagcuccugaagacggaggucaccaaccccgcggugcugcgcaagcucugcaucgaggccaagaucuccaacaccaccacggacagccggugcccgacccagggcgaggccacccugguggaggagcaggacgccaacuucgucugccgccggaccuucguggaccgcggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucacgccccaggcccccacgaccgagauccagcucaccgacuacggggcccugacccuggacugcagcccccucacgggccuggacuucaacgagaugguccugcucaccaugaaggagaaguccuggcuggugcacaagcagugguuccuggaccucccgcugcccuggaccagcggggccagcaccucccaggagacguggaaccggcaggaccugcucgugaccuucaagaccgcccacgcgaagaagcaggaggucguggugcugggcagccaggagggcgccaugcacaccgcccugacggggaccaccgagauccagaccuccggcacgaccaccaucuucgccgggcaccucaagugccgccugaagauggacaagcugacccucaagggcaugagcuacgucaugugcacgggguccuucaagcuggagaaggagguggccgagacccagcacggcaccgugcugguccagaucaaguacgagggcaccgacgcgcccugcaagauccccuucagcacgcaggacgagaagggggugacccagaacggccggcugaucaccgccaacccgaucgugaccgacaaggagaagcccgucaacaucgaggccgagccgcccuucggggaguccuacaucgugaucggcgccggcgagaaggcgcucaagcugagcugguucaagaagggguccacgcugggcaaggccuucagcaccacccucaagggggcccagcgccuggccgcccugggcgacaccgcgugggacuucggguccaucggcggcguguucaacagcaucgggcgggccguccaccagguguucggcggggccuuccgcacccucuucggcgggauguccuggaucacccagggccugaugggcgcccugcuccuguggaugggggugaacgcccgcgaccggagcaucgcgcuggccuuccucgccaccggcgggguccugguguuccuggccaccaacgugcacgccuga

SEQ ID NO: 1451 - RNA, 300 nt, Artificial Sequence
  derived and/or modified CDS sequence (opt1) from DENV-2 CYD2-T__C
augaacaaccagcgcaagaaggccaagaacacccccuucaacaugcugaagcgggagcgcaaccgggugagcaccguccagcagcucacgaagcgcuucagccugggcaugcugcaggggcggggcccccucaagcuguucauggcccugguggcguuccuccgcuuccugaccaucccgcccaccgccgggauccugaagcgguggggcaccaucaagaaguccaaggccaucaacgugcuccgcggguuccggaaggagaucggccgcaugcugaacauccugaaccggcgccggcgc

SEQ ID NO: 1452 - RNA, 342 nt, Artificial Sequence
  derived and/or modified CDS sequence (opt1) from DENV-2 CYD2-T__C-SSc
augaacaaccagcgcaagaaggccaagaacacccccuucaacaugcugaagcgggagcgcaaccgggugagcaccguccagcagcucacgaagcgcuucucccugggcaugcugcaggggcggggcccccucaagcuguucauggcccugguggcguuccuccgcuuccugaccaucccgcccaccgccgggauccugaagcgguggggcaccaucaagaaguccaaggccaucaacgugcuccgcggguuccggaaggagaucggccgcaugcugaacauccugaaccggcgccggcgcagcgccggcaugaucaucaugcucauccccacggucauggcc

SEQ ID NO: 1453 - RNA, 273 nt, Artificial Sequence
  derived and/or modified CDS sequence (opt1) from DENV-2 CYD2-T__pr
uuccaccugaccacccgcaacggcgagccccacaugaucgugagccggcaggagaaggggaagucccuccuguucaagacggaggacggcgucaacaugugcacccugauggccauggaccucggggagcugugcgaggacaccaucaccuacaagugcccgcugcuccgccagaacgagcccgaggacaucgacugcuggugcaacagcacguccaccugggugaccuacgggaccugcacgaccaugggcgagcaccggcgcgagaagcgg

SEQ ID NO: 1454 - RNA, 225 nt, Artificial Sequence
  derived and/or modified CDS sequence (opt1) from DENV-2 CYD2-T__M
agcguggcccuggucccccacgugggcauggggcucgagacccgcaccgagacguggauguccagcgagggcgccuggaagcacgugcagcggaucgagaccuggauccugcgccacccgggguucaccaugauggcggccauccuggccuacaccaucggcacgacccacuuccagcgggcccucaucuucauccugcugaccgccgucacccccuccaugacg

SEQ ID NO: 1455 - RNA, 498 nt, Artificial Sequence
  derived and/or modified CDS sequence (opt1) from DENV-2 CYD2-T__prM
uuccaccugaccacccgcaacggcgagccccacaugaucgugagccggcaggagaaggggaagucccuccuguucaagacggaggacggcgucaacaugugcacccugauggccauggaccucggggagcugugcgaggacaccaucaccuacaagugcccgcugcuccgccagaacgagcccgaggacaucgacugcuggugcaacagcacguccaccugggugaccuacgggaccugcacgaccaugggcgagcaccggcgcgagaagcggagcguggcccuggucccccacgugggcaugggccuggagacccgcaccgagacguggauguccagcgagggggcguggaagcacgugcagcggaucgagaccuggauccuccgccaccccggcuucaccaugauggccgccauccuggccuacaccaucgggacgacccacuuccagcgggcccugaucuucauccuccugaccgcggucaccccguccaugacg

SEQ ID NO: 1456 - RNA, 1485 nt, Artificial Sequence
  derived and/or modified CDS sequence (opt1) from DENV-2 CYD2-T__E
augcgcugcaucggcaugagcaaccgggacuucguggagggggucuccggcgggagcuggguggacaucgugcuggagcacggcuccugcgucaccaccauggccaagaacaagcccacgcucgacuucgagcugaucaagaccgaggccaagcagccggcgacccugcgcaaguacugcaucgaggccaagcucaccaacacgaccaccgagagccggugccccacccagggggagcccucccugaacgaggagcaggacaagcgcuucgugugcaagcacagcaugguggaccggggcuggggcaacgggugcggccuguucgggaagggcgggaucgucacgugcgccauguuccgcugcaagaagaacauggagggcaagguggugcagcccgagaaccucgaguacaccaucgucaucaccccgcacuccggcgaggagcacgccguggggaacgacaccggcaagcacgggaaggagaucaagaucacgccccagagcuccaucaccgaggccgagcugaccggcuacggcaccgugacgauggagugcagcccccggaccgggcuggacuucaacgagaugguccuccugcagauggagaacaaggcguggcuggugcaccgccagugguuccucgaccugccccugccguggcuccccggcgccgacacccagggguccaacuggauccagaaggagacccuggugacguucaagaacccccacgccaagaagcaggacgucguggugcugggcagccaggagggggccaugcacaccgcgcucaccggcgccaccgagauccagauguccagcggcaaccugcuguucacggggcaccucaagugccggcugcgcauggacaagcugcagcucaagggcauguccuacagcaugugcaccgggaaguucaaggucgugaaggagaucgccgagacccagcacggcaccaucgugauccggguccaguacgagggggacggcucccccugcaagaucccguucgagaucauggaccuggagaagcgccacgugcugggccggcucaucacggugaaccccaucgucaccgagaaggacagccccgugaacaucgaggccgagcccccguucggggacuccuacaucaucaucggcgucgagcccgggcagcugaagcugaacugguucaagaagggcagcagcaucgggcagauguucgagaccaccaugcgcggcgccaagcggauggcgauccucggcgacacggccugggacuucgggucccugggcgggguguucaccagcaucggcaaggcccugcaccagguguucggcgccaucuacggggccgcguucuccggcgucagcuggaccaugaagauccucaucggggugaucaucaccuggaucggcaugaacucccgcagcacgucccugagcgugacccugguccucguggggaucgugacccuguaccugggcgucauggugcaggcc

SEQ ID NO: 1457 - RNA, 1983 nt, Artificial Sequence
  derived and/or modified CDS sequence (opt1) from DENV-2 CYD2-T__prME
uuccaccugaccacccgcaacggcgagccccacaugaucgugagccggcaggagaaggggaagucccuccuguucaagacggaggacggcgucaacaugugcacccugauggccauggaccucggggagcugugcgaggacaccaucaccuacaagugcccccugcuccgccagaacgagcccgaggacaucgacugcuggugcaacagcacguccaccugggugaccuacgggaccugcacgaccaugggggagcaccggcgcgagaagcggagcguggcccuggucccccacgugggcaugggccuggagacccgcaccgagacguggauguccagcgagggggcguggaagcacgugcagcggaucgagaccuggauccuccgccaccccggcuucaccaugauggccgccauccuggccuacaccaucgggacgacccacuuccagcgggcccugaucuucauccuccugaccgcggucaccccguccaugacgaugcgcugcaucggcaugagcaaccgggacuucguggaggggguguccggcggcagcugggucgacaucgugcuggagcacggguccugcgugaccaccauggccaagaacaagcccacccucgacuucgagcugaucaagacggaggccaagcagcccgccacccugcgcaaguacugcaucgaggcgaagcucaccaacaccacgaccgagagccggugccccacccagggcgagccgucccugaacgaggagcaggacaagcgcuucgucugcaagcacagcaugguggaccggggguggggcaacggcugcgggcuguucggcaagggcggcaucgugaccugcgccauguuccgcugcaagaagaacauggaggggaaggucgugcagcccgagaaccucgaguacacgaucgugaucacgccccacuccggcgaggagcacgccgucggcaacgacaccgggaagcacggcaaggagaucaagaucacgccccagagcuccaucaccgaggccgagcugaccggguacggcaccgugaccauggagugcagcccgcggaccgggcuggacuucaacgagauggugcuccugcagauggagaacaaggccuggcugguccaccgccagugguuccucgaccugccccugcccuggcuccccggcgcggacacccagggcuccaacuggauccagaaggagacccuggugaccuucaagaacccgcacgccaagaagcaggacguggucgugcuggggagccaggagggcgccaugcacaccgcccucacgggggccaccgagauccagaugagcuccggcaaccugcuguucaccgggcaccucaagugccggcugcgcauggacaagcugcagcucaagggcaugagcuacuccaugugcaccggcaaguucaaggucgugaaggagaucgcggagacgcagcacgggaccaucgugauccggguccaguacgagggcgacgggagccccugcaagauccccuucgagaucauggaccuggagaagcgccacgugcugggccgccucaucaccgugaaccccaucgucaccgagaaggacuccccggugaacaucgaggccgagccgcccuucggcgacagcuacaucaucaucgggguggagcccggccagcugaagcugaacugguucaagaagggguccagcaucggccagauguucgagacgaccaugcgcggggccaagcggauggccauccucggcgacaccgccugggacuucggcucccucgggggcgucuucaccagcaucgggaaggcgcugcaccagguguucggcgccaucuacggggccgccuucuccggcgugagcuggacgaugaagauccugaucggcgucaucaucaccuggaucgggaugaacucccggagcaccucccugagcgugacccuggugcuggucggcaucgugacgcucuaccugggggugaugguccaggcc

SEQ ID NO: 1458 - RNA, 2025 nt, Artificial Sequence
  derived and/or modified CDS sequence (opt1) from DENV-2 CYD2-T__SSc-prME
agcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucacgccccacagcggcgaggagcacgccguggggaacgacaccggcaagcacgggaaggagaucaagaucaccccgcaguccagcaucaccgaggcggagcugaccggcuacgggaccgugaccauggagugcagcccccggacgggccucgacuucaacgagaugguccugcugcagauggagaacaaggccuggcucgugcaccgccagugguuccuggaccugccccuccccuggcugccgggcgccgacacccagggguccaacuggauccagaaggagacccuggugaccuucaagaacccccacgccaagaagcaggacgucgugguccucggcagccaggagggggccaugcacacggcgcugaccggcgccaccgagauccagauguccagcgggaaccuccuguucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaacccgaucgugacggagaaggacagccccgugaacaucgaggccgagccgcccuucggggacuccuacaucaucaucggcgucgagcccgggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccuccaccagguguucggggccaucuacggcgccgcguucagcggcgucuccuggaccaugaagauccugaucggggugaucaucaccuggaucggcaugaacagccgguccaccagccuguccgugacgcugguccucguggggaucgugacccuguaccugggcgucauggugcaggcc

SEQ ID NO: 1459 - RNA, 2325 nt, Artificial Sequence
  derived and/or modified CDS sequence (opt1) from DENV-2 CYD2-T__C-prME
augaacaaccagcgcaagaaggccaagaacacccccuucaacaugcugaagcgggagcgcaaccgggugagcaccguccagcagcucacgaagcgcuucucccugggcaugcugcaggggcggggcccgcucaagcuguucauggcccugguggcguuccuccgcuuccugaccaucccgcccaccgccgggauccugaagcgguggggcaccaucaagaaguccaaggccaucaacgugcuccgcggguuccggaaggagaucggccgcaugcugaacauccugaaccggcgccggcgcuccgccggcaugaucaucaugcucauccccacggucauggccuuccaccugaccacccggaacggggagccccacaugaucgugagccgccaggagaagggcaagucccuccuguucaagaccgaggacggggugaacaugugcacgcugauggcgauggaccugggcgagcucugcgaggacaccaucaccuacaagugcccccugcugcggcagaacgagcccgaggacaucgacugcuggugcaacagcaccuccacgugggucaccuacgggaccugcaccacgaugggcgagcaccgccgggagaagcgcagcguggcccucgugccccacgucggcauggggcuggagacccggaccgagaccuggauguccagcgagggcgccuggaagcacgugcagcgcaucgagacguggauccugcgccacccgggguucaccaugauggccgcgauccucgccuacaccaucggcaccacgcacuuccagcgggcccugaucuucauccugcucaccgccgugacccccuccaugaccaugcgcugcaucggcaugagcaaccgggacuucgucgaggggguguccggcgggagcuggguggacaucguccuggagcacggcuccugcgugacgaccauggccaagaacaagcccacccuggacuucgagcucaucaagaccgaggcgaagcagcccgccacgcugcgcaaguacugcaucgaggccaagcugaccaacaccaccacggagagccggugcccgacccagggggagcccucccucaacgaggagcaggacaagcgcuucgugugcaagcacagcauggucgaccggggcuggggcaacgggugcggccuguucgggaagggcgggaucgugaccugcgccauguuccgcugcaagaagaacauggagggcaaggugguccagcccgagaaccuggaguacaccaucgugaucacgccccacuccggcgaggagcacgccguggggaacgacaccggcaagcacgggaaggagaucaagaucaccccgcagagcagcaucaccgaggcggagcucaccggcuacgggacggucaccauggagugcagcccccggaccggccuggacuucaacgagauggugcugcuccagauggagaacaaggccuggcugguccaccgccagugguuccuggaccucccccugcccuggcugccgggcgccgacacccaggggagcaacuggauccagaaggagacgcucgugaccuucaagaacccccacgccaagaagcaggacguggucgugcugggcucccaggagggggccaugcacaccgcgcugaccggcgccacggagauccagaugagcuccggcaaccuccuguucaccgggcaccugaagugccggcugcgcauggacaagcuccagcugaagggcaugagcuacuccaugugcaccgggaaguucaagguggucaaggagaucgccgagacccagcacggcacgaucgugauccgggugcaguacgagggggacggcagccccugcaagauccccuucgagaucauggaccuggagaagcgccacguccucggccggcugaucaccgugaacccgaucgugaccgagaaggacucccccgucaacaucgaggccgagccgcccuucggggacagcuacaucaucaucggcguggagcccgggcagcugaagcucaacugguucaagaagggcuccagcaucgggcagauguucgagaccacgaugcgcggcgccaagcggauggcgauccugggcgacaccgccugggacuucgggucccugggcgggguguucaccagcaucggcaaggcccuccaccaggucuucggggccaucuacggcgcggccuucuccggcgugagcuggaccaugaagauccugaucggggugaucaucacguggaucggcaugaacucccgcagcaccucccugagcgucacccucgugcugguggggaucgucacccuguaccucggcgugauggugcaggcc

SEQ ID NO: 1460 - RNA, 45 nt, Artificial Sequence; identical to SEQ ID NO: 1304
  derived and/or modified CDS sequence (opt1) from DENV-2 CYD2-T__SSc

SEQ ID NO: 1461 - RNA, 57 nt, Artificial Sequence
  derived and/or modified CDS sequence (opt1) from DENV-2 CYD2-T__SSopt
augaagcgcaagaagagcgccggcaugaucaucaugcugauccccaccgugauggcc

SEQ ID NO: 1462 - RNA, 57 nt, Artificial Sequence
  derived and/or modified CDS sequence (opt1) from DENV-2 CYD2-T__SSm
auguuccagcgcgcccugaucuucauccuccugaccgccgugacccccagcaugacg

SEQ ID NO: 1463 - RNA, 1488 nt, Artificial Sequence
  derived and/or modified CDS sequence (opt1) from DENV-2 CYD2-T__E
augcgcugcaucggcaugagcaaccgggacuucguggagggggucuccggcgggagcuggguggacaucgugcuggagcacggcuccugcgucaccaccauggccaagaacaagcccacgcucgacuucgagcugaucaagaccgaggccaagcagccggcgacccugcgcaaguacugcaucgaggccaagcucaccaacacgaccaccgagagccggugccccacccagggggagcccucccugaacgaggagcaggacaagcgcuucgugugcaagcacagcaugguggaccggggcuggggcaacgggugcggccuguucgggaagggcgggaucgucacgugcgccauguuccgcugcaagaagaacauggagggcaagguggugcagcccgagaaccucgaguacaccaucgucaucaccccgcacuccggcgaggagcacgccguggggaacgacaccggcaagcacgggaaggagaucaagaucacgccccagagcuccaucaccgaggccgagcugaccggcuacggcaccgugacgauggagugcagcccccggaccgggcuggacuucaacgagaugguccuccugcagauggagaacaaggcguggcuggugcaccgccagugguuccucgaccugccccugccguggcuccccggcgccgacacccagggguccaacuggauccagaaggagacccuggugacguucaagaacccccacgccaagaagcaggacgucguggugcugggcagccaggagggggccaugcacaccgcgcucaccggcgccaccgagauccagauguccagcggcaaccugcuguucacggggcaccucaagugccggcugcgcauggacaagcugcagcucaagggcauguccuacagcaugugcaccgggaaguucaaggucgugaaggagaucgccgagacccagcacggcaccaucgugauccggguccaguacgagggggacggcucccccugcaagaucccguucgagaucauggaccuggagaagcgccacgugcugggccggcucaucacggugaaccccaucgucaccgagaaggacagccccgugaacaucgaggccgagcccccguucggggacuccuacaucaucaucggcgucgagcccgggcagcugaagcugaacugguucaagaagggcagcagcaucgggcagauguucgagaccaccaugcgcggcgccaagcggauggcgauccucggcgacacggccugggacuucgggucccugggcgggguguucaccagcaucggcaaggcccugcaccagguguucggcgccaucuacggggccgcguucuccggcgucagcuggaccaugaagauccucaucggggugaucaucaccuggaucggcaugaacucccgcagcacgucccugagcgugacccugguccucguggggaucgugacccuguaccugggcgucauggugcaggccuga

SEQ ID NO: 1464 - RNA, 1182 nt, Artificial Sequence
  derived and/or modified CDS sequence (opt1) from DENV-2 CYD2-T__EdelTM-variant (aa1-394)
augcgcugcaucggcaugagcaaccgggacuucguggagggggucuccggcgggagcuggguggacaucgugcuggagcacggcuccugcgucaccaccauggccaagaacaagcccacgcucgacuucgagcugaucaagaccgaggccaagcagccggcgacccugcgcaaguacugcaucgaggccaagcucaccaacacgaccaccgagagccggugccccacccagggggagcccucccugaacgaggagcaggacaagcgcuucgugugcaagcacagcaugguggaccggggcuggggcaacgggugcggccuguucgggaagggcgggaucgucacgugcgccauguuccgcugcaagaagaacauggagggcaagguggugcagcccgagaaccucgaguacaccaucgucaucaccccgcacuccggcgaggagcacgccguggggaacgacaccggcaagcacgggaaggagaucaagaucacgccccagagcuccaucaccgaggccgagcugaccggcuacggcaccgugacgauggagugcagcccccggaccgggcuggacuucaacgagaugguccuccugcagauggagaacaaggcguggcuggugcaccgccagugguuccucgaccugccccugccguggcuccccggcgccgacacccagggguccaacuggauccagaaggagacccuggugacguucaagaacccccacgccaagaagcaggacgucguggugcugggcagccaggagggggccaugcacaccgcgcucaccggcgccaccgagauccagauguccagcggcaaccugcuguucacggggcaccucaagugccggcugcgcauggacaagcugcagcucaagggcauguccuacagcaugugcaccgggaaguucaaggucgugaaggagaucgccgagacccagcacggcaccaucgugauccggguccaguacgagggggacggcucccccugcaagaucccguucgagaucauggaccuggagaagcgccacgugcugggccggcucaucacggugaaccccaucgucaccgagaaggacagccccgugaacaucgaggccgagcccccguucggggacuccuacaucaucaucggcgucgagcccgggcagcugaagcugaacugguucaagaag

SEQ ID NO: 1465 - RNA, 1272 nt, Artificial Sequence
  derived and/or modified CDS sequence (opt1) from DENV-2 CYD2-T__EdelTM-variant (aa1-424)
augcgcugcaucggcaugagcaaccgggacuucguggagggggucuccggcgggagcuggguggacaucgugcuggagcacggcuccugcgucaccaccauggccaagaacaagcccacgcucgacuucgagcugaucaagaccgaggccaagcagccggcgacccugcgcaaguacugcaucgaggccaagcucaccaacacgaccaccgagagccggugccccacccagggggagcccucccugaacgaggagcaggacaagcgcuucgugugcaagcacagcaugguggaccggggcuggggcaacgggugcggccuguucgggaagggcgggaucgucacgugcgccauguuccgcugcaagaagaacauggagggcaagguggugcagcccgagaaccucgaguacaccaucgucaucaccccgcacuccggcgaggagcacgccguggggaacgacaccggcaagcacgggaaggagaucaagaucacgccccagagcuccaucaccgaggccgagcugaccggcuacggcaccgugacgauggagugcagcccccggaccgggcuggacuucaacgagaugguccuccugcagauggagaacaaggcguggcuggugcaccgccagugguuccucgaccugccccugccguggcuccccggcgccgacacccagggguccaacuggauccagaaggagacccuggugacguucaagaacccccacgccaagaagcaggacgucguggugcugggcagccaggagggggccaugcacaccgcgcucaccggcgccaccgagauccagauguccagcggcaaccugcuguucacggggcaccucaagugccggcugcgcauggacaagcugcagcucaagggcauguccuacagcaugugcaccgggaaguucaaggucgugaaggagaucgccgagacccagcacggcaccaucgugauccggguccaguacgagggggacggcucccccugcaagaucccguucgagaucauggaccuggagaagcgccacgugcugggccggcucaucacggugaaccccaucgucaccgagaaggacagccccgugaacaucgaggccgagcccccguucggggacuccuacaucaucaucggcgucgagcccgggcagcugaagcugaacugguucaagaagggcagcagcaucgggcagauguucgagaccaccaugcgcggcgccaagcggauggcgauccucggcgacacggccugggacuucgggucc

SEQ ID NO: 1466 - RNA, 1263 nt, Artificial Sequence
  derived and/or modified CDS sequence (opt1) from DENV-2 CYD2-T__EdelTM-variant (aa1-421)
augcgcugcaucggcaugagcaaccgggacuucguggagggggucuccggcgggagcuggguggacaucgugcuggagcacggcuccugcgucaccaccauggccaagaacaagcccacgcucgacuucgagcugaucaagaccgaggccaagcagccggcgacccugcgcaaguacugcaucgaggccaagcucaccaacacgaccaccgagagccggugccccacccagggggagcccucccugaacgaggagcaggacaagcgcuucgugugcaagcacagcaugguggaccggggcuggggcaacgggugcggccuguucgggaagggcgggaucgucacgugcgccauguuccgcugcaagaagaacauggagggcaagguggugcagcccgagaaccucgaguacaccaucgucaucaccccgcacuccggcgaggagcacgccguggggaacgacaccggcaagcacgggaaggagaucaagaucacgccccagagcuccaucaccgaggccgagcugaccggcuacggcaccgugacgauggagugcagcccccggaccgggcuggacuucaacgagaugguccuccugcagauggagaacaaggcguggcuggugcaccgccagugguuccucgaccugccccugccguggcuccccggcgccgacacccagggguccaacuggauccagaaggagacccuggugacguucaagaacccccacgccaagaagcaggacgucguggugcugggcagccaggagggggccaugcacaccgcgcucaccggcgccaccgagauccagauguccagcggcaaccugcuguucacggggcaccucaagugccggcugcgcauggacaagcugcagcucaagggcauguccuacagcaugugcaccgggaaguucaaggucgugaaggagaucgccgagacccagcacggcaccaucgugauccggguccaguacgagggggacggcucccccugcaagaucccguucgagaucauggaccuggagaagcgccacgugcugggccggcucaucacggugaaccccaucgucaccgagaaggacagccccgugaacaucgaggccgagcccccguucggggacuccuacaucaucaucggcgucgagcccgggcagcugaagcugaacugguucaagaagggcagcagcaucgggcagauguucgagaccaccaugcgcggcgccaagcggauggcgauccucggcgacacggccugggac

SEQ ID NO: 1467 - RNA, 2031 nt, Artificial Sequence
  derived and/or modified CDS sequence (opt1) from DENV-2 CYD2-T__SSc-prME
augagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucacgccccacagcggcgaggagcacgccguggggaacgacaccggcaagcacgggaaggagaucaagaucaccccgcaguccagcaucaccgaggcggagcugaccggcuacgggaccgugaccauggagugcagcccccggacgggccucgacuucaacgagaugguccugcugcagauggagaacaaggccuggcucgugcaccgccagugguuccuggaccugccccuccccuggcugccgggcgccgacacccagggguccaacuggauccagaaggagacccuggugaccuucaagaacccccacgccaagaagcaggacgucgugguccucggcagccaggagggggccaugcacacggcgcugaccggcgccaccgagauccagauguccagcgggaaccuccuguucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaacccgaucgugacggagaaggacagccccgugaacaucgaggccgagccgcccuucggggacuccuacaucaucaucggcgucgagcccgggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccuccaccagguguucggggccaucuacggcgccgcguucagcggcgucuccuggaccaugaagauccugaucggggugaucaucaccuggaucggcaugaacagccgguccaccagccuguccgugacgcugguccucguggggaucgugacccuguaccugggcgucauggugcaggccuga

SEQ ID NO: 1468 - RNA, 2031 nt, Artificial Sequence
  derived and/or modified CDS sequence (opt1) from DENV-2 CYD2-T__SSc-prME(F108S)
augagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucagcgggaagggcgggaucgucacgugcgccauguuccgcugcaagaagaacauggagggcaagguggugcagcccgagaaccuggaguacaccaucgucaucacgccccacuccggcgaggagcacgccguggggaacgacaccggcaagcacgggaaggagaucaagaucaccccgcagagcuccaucaccgaggcggagcugaccggcuacgggaccgugaccauggagugcagcccccggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcucccaggagggggccaugcacacggcgcugaccggcgccaccgagauccagaugagcuccgggaaccuccuguucaccggccaccugaagugccggcugcgcauggacaagcuccagcugaagggcaugagcuacuccaugugcacggggaaguucaagguggugaaggagaucgccgagacccagcacggcaccaucgucauccgggugcaguacgagggggacggcagccccugcaagauccccuucgagaucauggaccuggagaagcgccacgugcucggccgccugaucaccgucaacccgaucgugacggagaaggacucccccgugaacaucgaggccgagccgcccuucggggacagcuacaucaucaucggcgucgagcccgggcagcugaagcucaacugguucaagaagggcuccagcaucgggcagauguucgagaccaccaugcggggcgccaagcgcauggcgauccugggcgacaccgccugggacuucgggucccugggcgggguguucacgagcaucggcaaggcccuccaccagguguucggggccaucuacggcgccgcguucuccggcgucagcuggaccaugaagauccugaucggggugaucaucaccuggaucggcaugaacucccggagcaccucccugagcgugacgcugguccucguggggaucgugacccuguaccugggcgucauggugcaggccuga

SEQ ID NO: 1469 - RNA, 2031 nt, Artificial Sequence
  derived and/or modified CDS sequence (opt1) from DENV-2 CYD2-T__SSc-prMEdelstem_TM-JEV
augagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucacgccccacagcggcgaggagcacgccguggggaacgacaccggcaagcacgggaaggagaucaagaucaccccgcaguccagcaucaccgaggcggagcugaccggcuacgggaccgugaccauggagugcagcccccggacgggccucgacuucaacgagaugguccugcugcagauggagaacaaggccuggcucgugcaccgccagugguuccuggaccugccccuccccuggcugccgggcgccgacacccagggguccaacuggauccagaaggagacccuggugaccuucaagaacccccacgccaagaagcaggacgucgugguccucggcagccaggagggggccaugcacacggcgcugaccggcgccaccgagauccagauguccagcgggaaccuccuguucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaacccgaucgugacggagaaggacagccccgugaacaucgaggccgagccgcccuucggggacuccuacaucaucaucggcgucgagcccgggcagcugaagcucaacugguucaagaagggcagcacccuggggaaggccuucuccaccacccugaagggcgcgcagcggcucgccgcccugggcgacacggccugggacuucgggagcaucggcgggguguucaacuccaucggccgcgccgugcaccaggucuucgggggcgcguuccggacccuguucggcgggaugagcuggaucacccagggccugaugggggcccuccugcuguggaugggcgugaacgcccgcgaccgguccaucgcccucgcguuccuggccaccgggggcgugcuggucuuccucgccacgaacgugcacgccuga

SEQ ID NO: 1470 - RNA, 1332 nt, Artificial Sequence
  derived and/or modified CDS sequence (opt1) from DENV-2 CYD2-T__SSm-EdelTM
auguuccagcgcgcccugaucuucauccuccugaccgccgugacccccagcaugacgaugcggugcaucggcauguccaaccgcgacuucgucgagggggugagcggcggguccuggguggacaucguccuggagcacggcagcugcgugaccaccauggcgaagaacaagccgacccucgacuucgagcugaucaagacggaggccaagcagcccgccacccugcggaaguacugcaucgaggccaagcucaccaacaccacgaccgagucccgcugccccacccagggggagcccagccugaacgaggagcaggacaagcgguucgugugcaagcacuccauggucgaccgcggcuggggcaacgggugcggccuguucgggaagggcgggaucgugaccugcgccauguuccggugcaagaagaacauggagggcaaggugguccagccggagaaccucgaguacacgaucgugaucacgccccacagcggcgaggagcacgcgguggggaacgacaccggcaagcacgggaaggagaucaagaucacgccccaguccagcaucaccgaggccgagcugaccggcuacggcaccgucaccauggagugcagcccccgcaccgggcuggacuucaacgagauggugcuccugcagauggagaacaaggccuggcuggugcaccggcagugguuccucgaccugccgcugcccuggcuccccggcgccgacacccagggguccaacuggauccagaaggagacccuggucaccuucaagaacccccacgcgaagaagcaggacguggugguccugggcucccaggagggggccaugcacacggcccucaccggcgccaccgagauccagaugagcuccggcaaccugcuguucaccgggcaccucaagugccgccugcggauggacaagcugcagcucaagggcaugagcuacuccaugugcacggggaaguucaagguggugaaggagaucgccgagacccagcacggcaccaucgucauccgcgugcaguacgagggggacggcagcccgugcaagauccccuucgagaucauggaccuggagaagcggcacgugcugggccgccucaucaccgucaaccccaucgugacggagaaggacucccccgucaacaucgaggcggagccgcccuucggggacagcuacaucaucaucggcguggagcccgggcagcugaagcugaacugguucaagaagggcagcuccaucgggcagauguucgagaccaccaugcggggcgccaagcgcauggccauccucggcgacaccgccugggacuucgggagcuga

SEQ ID NO: 1471 - RNA, 2379 nt, Artificial Sequence
  derived and/or modified CDS sequence (opt1) from DENV-2 CYD2-T__C-P2A-SSc-prME
augaacaaccagcgcaagaaggccaagaacacccccuucaacaugcugaagcgggagcgcaaccgggugagcaccguccagcagcucacgaagcgcuucucccugggcaugcugcaggggcggggcccgcucaagcuguucauggcccugguggcguuccuccgcuuccugaccaucccgcccaccgccgggauccugaagcgguggggcaccaucaagaaguccaaggccaucaacgugcuccgcggguuccggaaggagaucggccgcaugcugaacauccugaaccggcgccggcgcaacuucgaccuccugaagcuggccggcgacgucgagagcaaccccgggcccagcgccggcaugaucaucaugcucauccccacggugauggcguuccaccugaccacccggaacggggagccccacaugaucgugucccgccaggagaagggcaagagccugcuguucaagaccgaggacggggucaacaugugcacgcugauggccauggaccugggcgagcucugcgaggacaccaucaccuacaagugcccccugcugcggcagaacgagccggaggacaucgacugcuggugcaacuccaccagcacgugggugaccuacgggaccugcaccacgaugggcgagcaccgccgggagaagcgcuccguggcccucgucccccacgugggcauggggcuggagacccggaccgagaccuggaugagcuccgagggcgccuggaagcacgugcagcgcaucgagacguggauccugcgccaccccggcuucaccaugauggcggccauccucgccuacaccaucgggaccacgcacuuccagcgggcccugaucuucauccugcucaccgccgucacccccagcaugaccaugcgcugcaucggcauguccaaccgggacuucguggagggggugagcggcggguccugggucgacaucgugcuggagcacggcagcugcgugacgaccauggcgaagaacaagccgacccuggacuucgagcucaucaagaccgaggccaagcagcccgccacgcugcgcaaguacugcaucgaggccaagcugaccaacaccaccacggagucccggugccccacccagggcgagcccagccucaacgaggagcaggacaagcgcuucgucugcaagcacuccaugguggaccggggguggggcaacgggugcggccuguucgggaagggcggcaucgugaccugcgccauguuccgcugcaagaagaacauggaggggaaggucgugcagccggagaaccuggaguacaccaucgugaucacgccccacagcggcgaggagcacgcggucgggaacgacaccggcaagcacgggaaggagaucaagaucacgccccagagcuccaucaccgaggccgagcucaccggcuacggcaccgugaccauggagugcagcccccggaccgggcuggacuucaacgagaugguccugcuccagauggagaacaaggccuggcuggugcaccgccagugguuccuggaccucccgcugcccuggcugcccggcgccgacacccagggguccaacuggauccagaaggagacgcucgugaccuucaagaacccccacgccaagaagcaggacgucguggugcugggcagccaggagggcgcgaugcacaccgcccugaccggggccacggagauccagauguccagcggcaaccuccucuucaccgggcaccugaagugccggcugcgcauggacaagcuccagcugaagggcauguccuacagcaugugcaccgggaaguucaaggucgugaaggagaucgccgagacccagcacggcacgaucgugauccggguccaguacgagggcgacggguccccgugcaagauccccuucgagaucauggaccuggagaagcgccacgugcucggccggcugaucaccgugaaccccaucgucaccgagaaggacagccccgugaacaucgaggccgagccgcccuucggggacuccuacaucaucaucggcguggagcccgggcagcugaagcucaacugguucaagaagggcagcuccaucggccagauguucgagaccacgaugcgcggggcgaagcggauggccauccugggcgacaccgccugggacuucgggagccugggcggggucuucaccuccaucggcaaggcccuccaccagguguucggcgcgaucuacggggccgccuucagcggcguguccuggaccaugaagauccugaucggggucaucaucacguggaucggcaugaacagccgcuccaccagccugagcgugacccucgugcuggucgggaucgugacccuguaccucggcgugaugguccaggccuga

SEQ ID NO: 1472 - RNA, 2043 nt, Artificial Sequence
  derived and/or modified CDS sequence (opt1) from DENV-2 CYD2-T__SSopt-prME(F108S)
augaagcgcaagaaguccgccggcaugaucaucaugcugauccccaccgugauggccuuccaccucaccacgcggaacggggagccgcacaugaucgucagccgccaggagaagggcaagagccugcuguucaagaccgaggacggggugaacaugugcacccucauggcgauggaccugggcgagcugugcgaggacaccaucacguacaagugcccccuccugcggcagaacgagcccgaggacaucgacugcuggugcaacuccaccagcaccugggugaccuacgggacgugcaccaccaugggcgagcaccgccgggagaagcgcuccgucgcccuggugccccacgugggcauggggcucgagacccggacggagaccuggaugagcuccgagggcgccuggaagcacguccagcgcaucgagaccuggauccugcggcacccgggguucaccaugauggccgccauccuggcguacacgaucggcaccacccacuuccagcgcgcccucaucuucauccugcugaccgccgugacgcccagcaugaccaugcggugcaucgggauguccaaccgcgacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccggaaguacugcaucgaggccaagcugaccaacacgaccaccgagucccgcugcccgacccagggggagcccagccugaacgaggagcaggacaagcgguucgugugcaagcacuccaugguggaccgcggcuggggcaacgggugcggccucagcgggaagggcgggaucgucacgugcgccauguuccggugcaagaagaacauggagggcaagguggugcagcccgagaaccuggaguacaccaucgucaucacgccccacuccggcgaggagcacgccguggggaacgacaccggcaagcacgggaaggagaucaagaucaccccgcagagcuccaucaccgaggcggagcugaccggcuacgggaccgugaccauggagugcagcccccgcacgggccucgacuucaacgagaugguccugcugcagauggagaacaaggccuggcucgugcaccggcagugguuccuggaccugccccuccccuggcugccgggcgccgacacccaggggagcaacuggauccagaaggagacccuggugaccuucaagaacccccacgccaagaagcaggacgucgugguccucggcucccaggagggggccaugcacacggcgcugaccggcgccaccgagauccagaugagcuccgggaaccuccuguucaccggccaccugaagugccgccugcggauggacaagcuccagcugaagggcaugagcuacuccaugugcacggggaaguucaagguggugaaggagaucgccgagacccagcacggcaccaucgucauccgcgugcaguacgagggggacggcagccccugcaagauccccuucgagaucauggaccuggagaagcgccacgugcucggccggcugaucaccgucaacccgaucgugacggagaaggacucccccgugaacaucgaggccgagccgcccuucggggacagcuacaucaucaucggcgucgagcccgggcagcugaagcucaacugguucaagaagggcuccagcaucgggcagauguucgagaccaccaugcgcggcgccaagcggauggcgauccugggcgacaccgccugggacuucgggucccugggcgggguguucacgagcaucggcaaggcccuccaccagguguucggggccaucuacggcgccgcguucuccggcgucagcuggaccaugaagauccugaucggggugaucaucaccuggaucggcaugaacucccgcagcaccucccugagcgugacgcugguccucguggggaucgugacccuguaccugggcgucauggugcaggccuga

SEQ ID NO: 1473 - RNA, 2043 nt, Artificial Sequence
  derived and/or modified CDS sequence (opt1) from DENV-2 CYD2-T__SSopt-prME(M96H)
augaagcgcaagaaguccgccggcaugaucaucaugcugauccccaccgugauggccuuccaccucaccacgcggaacggggagccgcacaugaucgucucccgccaggagaagggcaagagccugcuguucaagaccgaggacggggugaacaugugcacccucauggcgauggaccugggcgagcugugcgaggacaccaucacguacaagugcccccuccugcggcagaacgagcccgaggacaucgacugcuggugcaacuccaccagcaccugggugaccuacgggacgugcaccaccaugggcgagcaccgccgggagaagcgcuccgucgcccuggugccccacgugggcauggggcucgagacccggacggagaccuggaugagcuccgagggcgccuggaagcacguccagcgcaucgagaccuggauccugcggcacccgggguucaccaugauggccgccauccuggcguacacgaucggcaccacccacuuccagcgcgcccucaucuucauccugcugaccgccgugacgcccagcaugaccaugcggugcaucgggauguccaaccgcgacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccggaaguacugcaucgaggccaagcugaccaacacgaccaccgagucccgcugcccgacccagggggagcccagccugaacgaggagcaggacaagcgguucgugugcaagcacucccacguggaccgcggcuggggcaacgggugcggccucuucgggaagggcgggaucgucacgugcgccauguuccggugcaagaagaacauggagggcaagguggugcagcccgagaaccuggaguacaccaucgucaucacgccccacagcggcgaggagcacgccguggggaacgacaccggcaagcacgggaaggagaucaagaucaccccgcaguccagcaucaccgaggcggagcugaccggcuacgggaccgugaccauggagugcagcccccgcacgggccucgacuucaacgagaugguccugcugcagauggagaacaaggccuggcucgugcaccggcagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccuccuguucaccggccaccugaagugccgccugcggauggacaagcuccagcugaagggcauguccuacagcaugugcacggggaaguucaagguggugaaggagaucgccgagacccagcacggcaccaucgucauccgcgugcaguacgagggggacggcucccccugcaagauccccuucgagaucauggaccuggagaagcgccacgugcucggccggcugaucaccgucaacccgaucgugacggagaaggacagccccgugaacaucgaggccgagccgcccuucggggacuccuacaucaucaucggcgucgagcccgggcagcugaagcucaacugguucaagaagggcagcuccaucgggcagauguucgagaccaccaugcgcggcgccaagcggauggcgauccugggcgacaccgccugggacuucgggagccugggcgggguguucacguccaucggcaaggcccuccaccagguguucggggccaucuacggcgccgcguucagcggcgucuccuggaccaugaagauccugaucggggugaucaucaccuggaucggcaugaacagccgcuccaccagccuguccgugacgcugguccucguggggaucgugacccuguaccugggcgucauggugcaggccuga

SEQ ID NO: 1474 - RNA, 2043 nt, Artificial Sequence
  derived and/or modified CDS sequence (opt1) from DENV-2 CYD2-T__SSopt-prME(S186F)
augaagcgcaagaaguccgccggcaugaucaucaugcugauccccaccgugauggccuuccaccucaccacgcggaacggggagccgcacaugaucgucagccgccaggagaagggcaagagccugcuguucaagaccgaggacggggugaacaugugcacccucauggcgauggaccugggcgagcugugcgaggacaccaucacguacaagugcccccuccugcggcagaacgagcccgaggacaucgacugcuggugcaacuccaccagcaccugggugaccuacgggacgugcaccaccaugggcgagcaccgccgggagaagcgcuccgucgcccuggugccccacgugggcauggggcucgagacccggacggagaccuggaugagcuccgagggcgccuggaagcacguccagcgcaucgagaccuggauccugcggcacccgggguucaccaugauggccgccauccuggcguacacgaucggcaccacccacuuccagcgcgcccucaucuucauccugcugaccgccgugacgcccagcaugaccaugcggugcaucgggauguccaaccgcgacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccggaaguacugcaucgaggccaagcugaccaacacgaccaccgagucccgcugcccgacccagggggagcccagccugaacgaggagcaggacaagcgguucgugugcaagcacuccaugguggaccgcggcuggggcaacgggugcggccucuucgggaagggcgggaucgucacgugcgccauguuccggugcaagaagaacauggagggcaagguggugcagcccgagaaccuggaguacaccaucgucaucacgccccacagcggcgaggagcacgccguggggaacgacaccggcaagcacgggaaggagaucaagaucaccccgcaguccagcaucaccgaggcggagcugaccggcuacgggaccgugaccauggagugcuucccccgcacgggccucgacuucaacgagaugguccugcugcagauggagaacaaggccuggcucgugcaccggcagugguuccuggaccugccccuccccuggcugccgggcgccgacacccagggguccaacuggauccagaaggagacccuggugaccuucaagaacccccacgccaagaagcaggacgucgugguccucggcagccaggagggggccaugcacacggcgcugaccggcgccaccgagauccagaugagcuccgggaaccuccuguucaccggccaccugaagugccgccugcggauggacaagcuccagcugaagggcaugagcuacuccaugugcacggggaaguucaagguggugaaggagaucgccgagacccagcacggcaccaucgucauccgcgugcaguacgagggggacggcagccccugcaagauccccuucgagaucauggaccuggagaagcgccacgugcucggccggcugaucaccgucaacccgaucgugacggagaaggacucccccgugaacaucgaggccgagccgcccuucggggacagcuacaucaucaucggcgucgagcccgggcagcugaagcucaacugguucaagaagggcuccagcaucgggcagauguucgagaccaccaugcgcggcgccaagcggauggcgauccugggcgacaccgccugggacuucgggucccugggcgggguguucacgagcaucggcaaggcccuccaccagguguucggggccaucuacggcgccgcguucuccggcgucagcuggaccaugaagauccugaucggggugaucaucaccuggaucggcaugaacucccgcagcaccucccugagcgugacgcugguccucguggggaucgugacccuguaccugggcgucauggugcaggccuga

SEQ ID NO: 1475 - RNA, 2043 nt, Artificial Sequence
  derived and/or modified CDS sequence (opt1) from DENV-2 CYD2-T__SSopt-prME(R188L)
augaagcgcaagaaguccgccggcaugaucaucaugcugauccccaccgugauggccuuccaccucaccacgcggaacggggagccgcacaugaucgucucccgccaggagaagggcaagagccugcuguucaagaccgaggacggggugaacaugugcacccucauggcgauggaccugggcgagcugugcgaggacaccaucacguacaagugcccccuccugcggcagaacgagcccgaggacaucgacugcuggugcaacuccaccagcaccugggugaccuacgggacgugcaccaccaugggcgagcaccgccgggagaagcgcuccgucgcccuggugccccacgugggcauggggcucgagacccggacggagaccuggaugagcuccgagggcgccuggaagcacguccagcgcaucgagaccuggauccugcggcacccgggguucaccaugauggccgccauccuggcguacacgaucggcaccacccacuuccagcgcgcccucaucuucauccugcugaccgccgugacgcccagcaugaccaugcggugcaucgggauguccaaccgcgacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccggaaguacugcaucgaggccaagcugaccaacacgaccaccgagucccgcugcccgacccagggggagcccagccugaacgaggagcaggacaagcgguucgugugcaagcacuccaugguggaccgcggcuggggcaacgggugcggccucuucgggaagggcgggaucgucacgugcgccauguuccggugcaagaagaacauggagggcaagguggugcagcccgagaaccuggaguacaccaucgucaucacgccccacagcggcgaggagcacgccguggggaacgacaccggcaagcacgggaaggagaucaagaucaccccgcaguccagcaucaccgaggcggagcugaccggcuacgggaccgugaccauggagugcagcccccucacgggccuggacuucaacgagaugguccugcuccagauggagaacaaggccuggcuggugcaccgccagugguuccuggaccucccccugcccuggcugccgggcgccgacacccaggggagcaacuggauccagaaggagacccucgugaccuucaagaacccccacgccaagaagcaggacgucgugguccugggcagccaggagggggccaugcacacggcgcugaccggcgccaccgagauccagauguccagcgggaaccuccuguucaccggccaccugaagugccggcuccgcauggacaagcugcagcugaagggcauguccuacagcaugugcacggggaaguucaagguggugaaggagaucgccgagacccagcacggcaccaucgucauccgggugcaguacgagggggacggcucccccugcaagauccccuucgagaucauggaccucgagaagcgccacgugcugggccgccugaucaccgucaacccgaucgugacggagaaggacagccccgugaacaucgaggccgagccgcccuucggggacuccuacaucaucaucggcgucgagcccgggcagcucaagcugaacugguucaagaagggcagcuccaucgggcagauguucgagaccaccaugcggggcgccaagcgcauggcgauccugggcgacaccgccugggacuucgggagccucggcgggguguucacguccaucggcaaggcccugcaccagguguucggggccaucuacggcgccgcguucagcggcgucuccuggaccaugaagauccugaucggggugaucaucaccuggaucggcaugaacagccgguccaccagccuguccgugacgcucguccugguggggaucgugacccuguaccucggcgucauggugcaggccuga

SEQ ID NO: 1476 - RNA, 2043 nt, Artificial Sequence
  derived and/or modified CDS sequence (opt1) from DENV-2 CYD2-T__SSopt-pr(D104A)MEdelstem_TM,(F108S)-JEV
augaagcgcaagaaguccgccggcaugaucaucaugcugauccccaccgugauggccuuccaccucaccacgcggaacggggagccgcacaugaucgucagccgccaggagaagggcaagagccugcuguucaagaccgaggacggggugaacaugugcacccucauggcgauggaccugggcgagcugugcgaggacaccaucacguacaagugcccccuccugcggcagaacgagcccgaggacaucgacugcuggugcaacuccaccagcaccugggugaccuacgggacgugcaccaccaugggcgagcaccgccgggccaagcgcuccgucgcccuggugccccacgugggcauggggcucgagacccggacggagaccuggaugagcuccgagggcgccuggaagcacguccagcgcaucgagaccuggauccugcggcacccgggguucaccaugauggccgcgauccuggccuacacgaucggcaccacccacuuccagcgcgcccucaucuucauccugcugaccgccgugacgcccagcaugaccaugcggugcaucgggauguccaaccgcgacuucguggagggcgucagcggcggguccuggguggacaucgugcucgagcacggcagcugcgucaccaccauggcgaagaacaagcccacgcuggacuucgagcugaucaagaccgaggccaagcagcccgccacccuccggaaguacugcaucgaggccaagcugaccaacacgaccaccgagucccgcugcccgacccagggggagcccagccugaacgaggagcaggacaagcgguucgugugcaagcacuccaugguggaccgcggcuggggcaacgggugcggccucagcgggaagggcgggaucgucacgugcgccauguuccggugcaagaagaacauggagggcaagguggugcagcccgagaaccuggaguacaccaucgucaucacgccccacuccggcgaggagcacgcgguggggaacgacaccggcaagcacgggaaggagaucaagaucaccccgcagagcuccaucaccgaggccgagcugaccggcuacgggaccgugaccauggagugcagcccccgcacgggccucgacuucaacgagaugguccugcugcagauggagaacaaggccuggcucgugcaccggcagugguuccuggaccugccccuccccuggcugccgggcgccgacacccaggggagcaacuggauccagaaggagacccuggugaccuucaagaacccccacgccaagaagcaggacgucgugguccucggcucccaggagggggcgaugcacacggcccugaccggcgccaccgagauccagaugagcuccgggaaccuccuguucaccggccaccugaagugccgccugcggauggacaagcuccagcugaagggcaugagcuacuccaugugcacggggaaguucaagguggugaaggagaucgccgagacccagcacggcaccaucgucauccgcgugcaguacgagggggacggcagccccugcaagauccccuucgagaucauggaccuggagaagcgccacgugcucggccggcugaucaccgucaacccgaucgugacggagaaggacucccccgugaacaucgaggccgagccgcccuucggggacagcuacaucaucaucggcgucgagcccgggcagcugaagcucaacugguucaagaagggcuccacccuggggaaggcguucagcaccacccugaagggcgcccagcgccucgccgcccugggcgacacggccugggacuucggguccaucggcgggguguucaacagcaucggccgggcggugcaccaggucuucgggggcgccuuccgcacccuguucggcgggauguccuggaucacccagggccugaugggggcccuccugcuguggaugggcgugaacgcccgggaccgcagcaucgcgcucgccuuccuggccaccgggggcgugcuggucuuccucgccacgaacgugcacgccuga

SEQ ID NO: 1477 - RNA, 2043 nt, Artificial Sequence
  derived and/or modified CDS sequence (opt1) from DENV-2 CYD2-T__SSopt-prMEdelstem_TM,(H261N)-JEV
augaagcgcaagaaguccgccggcaugaucaucaugcugauccccaccgugauggccuuccaccucaccacgcggaacggggagccgcacaugaucgucucccgccaggagaagggcaagagccugcuguucaagaccgaggacggggugaacaugugcacccucauggcgauggaccugggcgagcugugcgaggacaccaucacguacaagugcccccuccugcggcagaacgagcccgaggacaucgacugcuggugcaacuccaccagcaccugggugaccuacgggacgugcaccaccaugggcgagcaccgccgggagaagcgcuccgucgcccuggugccccacgugggcauggggcucgagacccggacggagaccuggaugagcuccgagggcgccuggaagcacguccagcgcaucgagaccuggauccugcggcacccgggguucaccaugauggccgccauccuggcguacacgaucggcaccacccacuuccagcgcgcccucaucuucauccugcugaccgccgugacgcccagcaugaccaugcggugcaucgggauguccaaccgcgacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccggaaguacugcaucgaggccaagcugaccaacacgaccaccgagucccgcugcccgacccagggggagcccagccugaacgaggagcaggacaagcgguucgugugcaagcacuccaugguggaccgcggcuggggcaacgggugcggccucuucgggaagggcgggaucgucacgugcgccauguuccggugcaagaagaacauggagggcaagguggugcagcccgagaaccuggaguacaccaucgucaucacgccccacagcggcgaggagcacgccguggggaacgacaccggcaagcacgggaaggagaucaagaucaccccgcaguccagcaucaccgaggcggagcugaccggcuacgggaccgugaccauggagugcagcccccgcacgggccucgacuucaacgagaugguccugcugcagauggagaacaaggccuggcucgugcaccggcagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugaacacggcgcugaccggcgccaccgagauccagauguccagcgggaaccuccuguucaccggccaccugaagugccgccugcggauggacaagcuccagcugaagggcauguccuacagcaugugcacggggaaguucaagguggugaaggagaucgccgagacccagcacggcaccaucgucauccgcgugcaguacgagggggacggcucccccugcaagauccccuucgagaucauggaccuggagaagcgccacgugcucggccggcugaucaccgucaacccgaucgugacggagaaggacagccccgugaacaucgaggccgagccgcccuucggggacuccuacaucaucaucggcgucgagcccgggcagcugaagcucaacugguucaagaagggcagcacccuggggaaggccuucuccaccacccugaagggcgcgcagcgccucgccgcccugggcgacacggccugggacuucgggagcaucggcgggguguucaacuccaucggccgggccgugcaccaggucuucgggggcgcguuccgcacccuguucggcgggaugagcuggaucacccagggccugaugggggcccuccugcuguggaugggcgugaacgcccgggaccgcuccaucgcccucgcguuccuggccaccgggggcgugcuggucuuccucgccacgaacgugcacgccuga

SEQ ID NO: 1478 - RNA, 2043 nt, Artificial Sequence
  derived and/or modified CDS sequence (opt1) from DENV-2 CYD2-T__SSopt-prMEdelstem_TM,(R188L,A267T)-JEV
augaagcgcaagaaguccgccggcaugaucaucaugcugauccccaccgugauggccuuccaccucaccacgcggaacggggagccgcacaugaucgucucccgccaggagaagggcaagagccugcuguucaagaccgaggacggggugaacaugugcacccucauggcgauggaccugggcgagcugugcgaggacaccaucacguacaagugcccccuccugcggcagaacgagcccgaggacaucgacugcuggugcaacuccaccagcaccugggugaccuacgggacgugcaccaccaugggcgagcaccgccgggagaagcgcuccgucgcccuggugccccacgugggcauggggcucgagacccggacggagaccuggaugagcuccgagggcgccuggaagcacguccagcgcaucgagaccuggauccugcggcacccgggguucaccaugauggccgccauccuggcguacacgaucggcaccacccacuuccagcgcgcccucaucuucauccugcugaccgccgugacgcccagcaugaccaugcggugcaucgggauguccaaccgcgacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccggaaguacugcaucgaggccaagcugaccaacacgaccaccgagucccgcugcccgacccagggggagcccagccugaacgaggagcaggacaagcgguucgugugcaagcacuccaugguggaccgcggcuggggcaacgggugcggccucuucgggaagggcgggaucgucacgugcgccauguuccggugcaagaagaacauggagggcaagguggugcagcccgagaaccuggaguacaccaucgucaucacgccccacagcggcgaggagcacgccguggggaacgacaccggcaagcacgggaaggagaucaagaucacgccgcaguccagcaucaccgaggcggagcugaccggcuacgggaccgugaccauggagugcagcccccucacgggccuggacuucaacgagaugguccugcuccagauggagaacaaggccuggcuggugcaccgccagugguuccuggaccucccccugcccuggcugccgggcgccgacacccaggggagcaacuggauccagaaggagacccucgugaccuucaagaacccccacgccaagaagcaggacgucgugguccugggcagccaggagggggccaugcacacggcgcugaccggcaccaccgagauccagauguccagcgggaaccuccuguucacgggccaccugaagugccggcuccgcauggacaagcugcagcugaagggcauguccuacagcaugugcaccgggaaguucaagguggugaaggagaucgccgagacccagcacggcaccaucgucauccgggugcaguacgagggggacggcucccccugcaagauccccuucgagaucauggaccucgagaagcgccacgugcugggccgccugaucacggucaacccgaucgugaccgagaaggacagccccgugaacaucgaggccgagccgcccuucggggacuccuacaucaucaucggcgucgagcccgggcagcucaagcugaacugguucaagaagggcagcacccuggggaaggccuucuccaccacgcucaagggcgcccagcggcuggcggcccugggcgacaccgccugggacuucgggagcaucggcgggguguucaacuccaucggccgcgccgugcaccaggucuucgggggcgccuuccggacccuguucggcgggaugagcuggaucacccagggccucaugggggcgcugcugcucuggaugggcgugaacgcccgcgaccgguccaucgcccuggccuuccuggcgaccgggggcgugcucgucuuccuggccaccaacgugcacgccuga

SEQ ID NO: 1479 - RNA, 297 nt, Artificial Sequence
  derived and/or modified CDS sequence (opt1) from DENV-4 Consensus__C
augaaccagcgcaagaaggugguccggcccccguucaacaugcugaagcgcgagcggaaccgcgugagcacgccccagggccucgugaagcgguucuccaccgggcuguucagcggcaaggggccccugcgcaugguccucgccuucaucaccuuccugcgggugcuguccaucccgcccaccgccggcauccucaagcgcugggggcagcugaagaagaacaaggcgaucaagauccugaucggcuuccggaaggagaucggccgcaugcucaacauccugaacgggcggaagcgc

SEQ ID NO: 1480 - RNA, 339 nt, Artificial Sequence
  derived and/or modified CDS sequence (opt1) from DENV-4 Consensus__C-SSc
augaaccagcgcaagaaggugguccggcccccguucaacaugcugaagcgcgagcggaaccgcgugagcacgccccagggccucgugaagcgguucuccaccgggcuguucagcggcaaggggccccugcgcaugguccucgccuucaucaccuuccugcgggugcuguccaucccgcccaccgccggcauccucaagcgcugggggcagcugaagaagaacaaggcgaucaagauccugaucggcuuccggaaggagaucggccgcaugcucaacauccugaacgggcggaagcgcagcaccaucacccugcucugccugauccccacggugauggcc

SEQ ID NO: 1481 - RNA, 273 nt, Artificial Sequence
  derived and/or modified CDS sequence (opt1) from DENV-4 Consensus__pr
uuccaccugagcacccgcgacggcgagccccucaugaucguggccaagcacgagcgggggcgcccgcugcuguucaagaccacggagggcaucaacaagugcacccucaucgccauggaccugggggagaugugcgaggacaccgucaccuacaagugcccccugcucgugaacacggagcccgaggacaucgacugcuggugcaaccugaccuccaccugggugauguacgggaccugcacgcagagcggcgagcggcgccgggagaagcgc

SEQ ID NO: 1482 - RNA, 225 nt, Artificial Sequence
  derived and/or modified CDS sequence (opt1) from DENV-4 Consensus__M
agcguggcccugacgccccacuccggcauggggcucgagacccgcgccgagaccuggaugagcuccgagggcgcguggaagcacgcccagcgggucgagagcuggauccugcgcaacccgggguucgcccugcucgccggcuucauggccuacaugaucgggcagaccggcauccagcggaccguguucuucgugcugaugaugcuggucgcgcccuccuacggc

SEQ ID NO: 1483 - RNA, 498 nt, Artificial Sequence
  derived and/or modified CDS sequence (opt1) from DENV-4 Consensus__prM
uuccaccugagcacccgcgacggcgagccccucaugaucguggccaagcacgagcgggggcgcccgcugcuguucaagaccacggagggcaucaacaagugcacccucaucgccauggaccugggggagaugugcgaggacaccgucaccuacaagugcccccugcucgugaacacggagcccgaggacaucgacugcuggugcaaccugaccuccaccugggugauguacgggaccugcacgcagagcggcgagcggcgccgggagaagcgcuccgucgcgcugacgccccacagcggcaugggccucgagacccgggccgagaccuggauguccagcgagggggccuggaagcacgcccagcgcguggaguccuggauccugcggaacccgggcuucgcccugcucgcgggguucauggccuacaugaucggccagaccgggauccagcgcaccguguucuucguccugaugaugcugguggcccccagcuacggc

SEQ ID NO: 1484 - RNA, 1485 nt, Artificial Sequence
  derived and/or modified CDS sequence (opt1) from DENV-4 Consensus__E
augcgcugcgugggcgucgggaaccgggacuucguggagggcgugagcgggggcgccugggucgaccuggugcucgagcacgggggcugcgugaccaccauggcccagggcaagcccacgcuggacuucgagcugaccaagaccaccgcgaaggaggucgcccuccugcgcacguacugcaucgaggccuccaucagcaacaucaccaccgccacccggugcccgacgcagggggagcccuaccugaaggaggagcaggaccagcaguacaucugccgccgggacgugguggaccgcggcugggggaacggcugcggccucuucgggaagggcggggucgugaccugcgccaaguucuccugcagcggcaagaucaccgggaaccuggugcagaucgagaaccuggaguacaccgucguggugacgguccacaacggcgacacccacgcggugggcaacgacaccuccaaccacggggugaccgccacgaucacgccccggagccccuccgucgaggugaagcucccggacuacggcgagcugacccuggacugcgagccccgcagcgggaucgacuucaacgagaugauccucaugaagaugaagaagaagaccuggcuggugcacaagcagugguuccuggaccucccccugcccuggaccgccggcgccgacaccuccgagguccacuggaacuacaaggagcggauggugaccuucaaggugccgcacgcgaagcgccaggacgucaccgugcuggggagccaggagggcgccaugcacuccgcccucgccggcgccacggaggucgacagcggggacggcaaccacauguucgcggggcaccugaagugcaaggugcggauggagaagcugcgcaucaagggcauguccuacaccaugugcagcgggaaguucuccaucgacaaggagauggccgagacccagcacggcaccacgguggucaaggugaaguacgagggcgccggggcccccugcaaggugcccaucgagauccgggacgucaacaaggagaagguggugggccgcgucaucagcuccacgccccucgccgagaacaccaacagcgugaccaacaucgagcuggagccgcccuucggggacuccuacaucgugaucggcgucgggaacagcgcgcugacccuccacugguuccggaagggcagcuccaucggcaagauguucgagagcaccuaccgcggggccaagcggauggccauccugggcgagaccgccugggacuucggguccgugggcggccuguucaccagccucgggaaggccgugcaccaggucuucggcuccguguacacgaccauguucgggggcgugagcuggaugauccgcauccugaucggguuccugguccucuggaucggcaccaacucccggaacaccagcauggcgaugaccugcaucgccgugggcgggaucacgcuguuccugggcuucaccgugcaggcc

SEQ ID NO: 1485 - RNA, 1983 nt, Artificial Sequence
  derived and/or modified CDS sequence (opt1) from DENV-4 Consensus__prME
uuccaccugagcacccgcgacggcgagccccucaugaucguggccaagcacgagcgggggcgcccgcugcuguucaagaccacggagggcaucaacaagugcacccucaucgccauggaccugggggagaugugcgaggacaccgucaccuacaagugcccccugcucgugaacacggagcccgaggacaucgacugcuggugcaaccugaccuccaccugggugauguacgggaccugcacgcagagcggcgagcggcgccgggagaagcgcuccgucgcgcugacgccccacagcggcaugggccucgagacccgggccgagaccuggauguccagcgagggggccuggaagcacgcccagcgcguggaguccuggauccugcggaacccgggcuucgcccugcucgcgggguucauggccuacaugaucggccagaccgggauccagcgcaccguguucuucguccugaugaugcugguggcccccagcuacggcaugcggugcgugggcgucgggaaccgcgacuucguggagggcguguccgggggcgccugggucgaccucgugcuggagcacggcgggugcgugaccaccauggcgcagggcaagcccacgcuggacuucgagcucaccaagaccaccgccaaggaggucgcccugcugcggacguacugcaucgaggccagcaucuccaacaucaccaccgccacccgcugccccacgcagggggagccguaccucaaggaggagcaggaccagcaguacaucugccggcgcgacgugguggaccggggcugggggaacggcugcggccuguucgggaagggcggggucgugaccugcgcgaaguucagcugcuccggcaagaucaccgggaaccuggugcagaucgagaaccucgaguacaccgucguggugacgguccacaacggcgacacccacgccgugggcaacgacaccagcaaccacggggucaccgccacgaucacgccccgcucccccagcguggaggugaagcugcccgacuacggcgagcugacccucgacugcgagccgcgguccgggaucgacuucaacgagaugauccugaugaagaugaagaagaagaccuggcugguccacaagcagugguuccucgaccugccccugcccuggaccgccggcgccgacaccagcgaggugcacuggaacuacaaggagcgcauggugaccuucaaggucccccacgcgaagcggcaggacgugaccgugcucgggucccaggagggcgccaugcacagcgcccuggccggcgccaccgaggucgacagcggggacggcaaccacauguucgcggggcaccugaagugcaaggugcgcauggagaagcuccgcaucaagggcauguccuacacgaugugcagcggcaaguucuccaucgacaaggagauggccgagacccagcacgggaccaccguggucaaggugaaguacgagggcgccggggccccgugcaaggugcccaucgagauccgggacgucaacaaggagaagguggugggccgcgucaucagcuccacgccccuggccgagaacaccaacagcgugaccaacaucgagcuggagcccccguucggggacuccuacaucgugaucggcgucggcaacagcgcgcucacccugcacugguuccggaagggguccagcaucggcaagauguucgaguccacguaccgcggggccaagcggauggccauccugggcgagaccgccugggacuucgggagcgugggcggccucuucaccucccuggggaaggcggugcaccaggucuucggcagcguguacaccacgauguucgggggcguguccuggaugauccgcauccugaucggguuccucguccuguggaucggcaccaacagccggaacaccuccauggccaugaccugcaucgccgugggcgggaucacgcuguuccucggcuucaccgugcaggcc

SEQ ID NO: 1486 - RNA, 2025 nt, Artificial Sequence
  derived and/or modified CDS sequence (opt1) from DENV-4 Consensus__SSc-prME
agcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggcgagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcacgccccuggcggagaacaccaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccucgugcuguggaucggcacgaacucccggaacaccagcauggccaugaccugcaucgccgugggcgggaucacccuguuccugggcuucacgguccaggcc

SEQ ID NO: 1487 - RNA, 2322 nt, Artificial Sequence
  derived and/or modified CDS sequence (opt1) from DENV-4 Consensus__C-prME
augaaccagcgcaagaaggugguccggccgcccuucaacaugcugaagcgcgagcggaaccgcgugagcacgccccagggccucgugaagcgguucuccaccgggcuguucagcggcaaggggccccugcgcaugguccucgccuucaucaccuuccugcgggugcuguccaucccgcccaccgccggcauccucaagcgcugggggcagcugaagaagaacaaggcgaucaagauccugaucggcuuccggaaggagaucggccgcaugcucaacauccugaacgggcggaagcgcagcaccaucacccugcucugccugauccccacggugauggccuuccaccuguccacccgggacggcgagccccucaugaucgucgccaagcacgagcgcgggcggccccugcuguucaagaccaccgagggcaucaacaagugcacgcucaucgccauggaccugggggagaugugcgaggacaccgugaccuacaagugcccgcugcucgugaacaccgagcccgaggacaucgacugcuggugcaaccugacgagcaccugggucauguacgggaccugcacccaguccggcgagcgccggcgcgagaagcggagcguggcccugacgccccacuccggcaugggccucgagacccgcgcggagaccuggaugagcuccgagggggccuggaagcacgcccagcggguggagagcuggauccugcgcaaccccggcuucgcccugcucgcgggcuucauggccuacaugaucgggcagaccggcauccagcgcacggucuucuucgugcugaugaugcugguggcccccuccuacgggaugcggugcgucggcguggggaaccgcgacuucguggagggcgucagcggcggggccuggguggaccucgugcuggagcacggcgggugcgucaccaccauggcccagggcaagcccacccuggacuucgagcucacgaagaccaccgcgaaggagguggcccugcugcggaccuacugcaucgaggccuccaucagcaacaucacgaccgccacccgcugccccacccagggggagcccuaccucaaggaggagcaggaccagcaguacaucugccggcgcgacguggucgaccggggcuggggcaacgggugcggccuguucgggaagggcgggguggucacgugcgccaaguucuccugcagcggcaagaucaccggcaaccuggugcagaucgagaaccucgaguacaccguggucgugaccgugcacaacggggacacgcacgcggucggcaacgacaccuccaaccacggggugaccgccaccaucaccccgcgcagccccagcguggaggucaagcugcccgacuacggcgagcugacgcucgacugcgagccccgguccggcaucgacuucaacgagaugauccugaugaagaugaagaagaagaccuggcuggugcacaagcagugguuccucgaccugccgcugcccuggaccgccggggccgacaccagcgaggugcacuggaacuacaaggagcgcauggucacguucaaggugccccacgccaagcggcaggacgugaccguccucggcucccaggagggggcgaugcacagcgcccuggccggcgccaccgagguggacuccggggacggcaaccacauguucgccggccaccugaagugcaaggugcgcauggagaagcugcggaucaaggggaugagcuacaccaugugcuccggcaaguucagcaucgacaaggagauggcggagacgcagcacgggaccaccgucgugaaggugaaguacgagggcgccggggcccccugcaaggucccgaucgagauccgcgacgugaacaaggagaagguggucggccgggugaucuccagcacgccccucgccgagaacaccaacuccgugaccaacaucgagcuggagccgcccuucggcgacagcuacaucgucaucggggugggcaacuccgcgcugacccuccacugguuccgcaaggggagcuccaucggcaagauguucgagagcaccuaccgcggggccaagcggauggccauccugggcgagacggccugggacuucggcuccgucgggggccuguucaccagccucgggaaggccgugcaccagguguucggcuccguguacaccaccauguucgggggcgucagcuggaugauccggauccugaucggcuuccuggugcucuggaucgggacgaacagccgcaacaccuccauggcgaugaccugcaucgccgugggcgggaucacccuguuccugggcuucacgguccaggcc

SEQ ID NO: 1488 - RNA, 45 nt, Artificial Sequence; identical to SEQ ID NO: 1332
  derived and/or modified CDS sequence (opt1) from DENV-4 Consensus__SSc

SEQ ID NO: 1489 - RNA, 57 nt, Artificial Sequence; identical to SEQ ID NO: 1333
  derived and/or modified CDS sequence (opt1) from DENV-4 Consensus__SSopt

SEQ ID NO: 1490 - RNA, 57 nt, Artificial Sequence
  derived and/or modified CDS sequence (opt1) from DENV-4 Consensus__SSm
augauccagcgcaccguguucuucguccugaugaugcucguggcccccagcuacggc

SEQ ID NO: 1491 - RNA, 1488 nt, Artificial Sequence
  derived and/or modified CDS sequence (opt1) from DENV-4 Consensus__E
augcgcugcgugggcgucgggaaccgggacuucguggagggcgugagcgggggcgccugggucgaccuggugcucgagcacgggggcugcgugaccaccauggcccagggcaagcccacgcuggacuucgagcugaccaagaccaccgcgaaggaggucgcccuccugcgcacguacugcaucgaggccuccaucagcaacaucaccaccgccacccggugcccgacgcagggggagcccuaccugaaggaggagcaggaccagcaguacaucugccgccgggacgugguggaccgcggcugggggaacggcugcggccucuucgggaagggcggggucgugaccugcgccaaguucuccugcagcggcaagaucaccgggaaccuggugcagaucgagaaccuggaguacaccgucguggugacgguccacaacggcgacacccacgcggugggcaacgacaccuccaaccacggggugaccgccacgaucacgccccggagccccuccgucgaggugaagcucccggacuacggcgagcugacccuggacugcgagccccgcagcgggaucgacuucaacgagaugauccucaugaagaugaagaagaagaccuggcuggugcacaagcagugguuccuggaccucccccugcccuggaccgccggcgccgacaccuccgagguccacuggaacuacaaggagcggauggugaccuucaaggugccgcacgcgaagcgccaggacgucaccgugcuggggagccaggagggcgccaugcacuccgcccucgccggcgccacggaggucgacagcggggacggcaaccacauguucgcggggcaccugaagugcaaggugcggauggagaagcugcgcaucaagggcauguccuacaccaugugcagcgggaaguucuccaucgacaaggagauggccgagacccagcacggcaccacgguggucaaggugaaguacgagggcgccggggcccccugcaaggugcccaucgagauccgggacgucaacaaggagaagguggugggccgcgucaucagcuccacgccccucgccgagaacaccaacagcgugaccaacaucgagcuggagccgcccuucggggacuccuacaucgugaucggcgucgggaacagcgcgcugacccuccacugguuccggaagggcagcuccaucggcaagauguucgagagcaccuaccgcggggccaagcggauggccauccugggcgagaccgccugggacuucggguccgugggcggccuguucaccagccucgggaaggccgugcaccaggucuucggcuccguguacacgaccauguucgggggcgugagcuggaugauccgcauccugaucggguuccugguccucuggaucggcaccaacucccggaacaccagcauggcgaugaccugcaucgccgugggcgggaucacgcuguuccugggcuucaccgugcaggccuga

SEQ ID NO: 1492 - RNA, 1182 nt, Artificial Sequence
  derived and/or modified CDS sequence (opt1) from DENV-4 Consensus__EdelTM-variant (aa1-394)
augcgcugcgugggcgucgggaaccgggacuucguggagggcgugagcgggggcgccugggucgaccuggugcucgagcacgggggcugcgugaccaccauggcccagggcaagcccacgcuggacuucgagcugaccaagaccaccgcgaaggaggucgcccuccugcgcacguacugcaucgaggccuccaucagcaacaucaccaccgccacccggugcccgacgcagggggagcccuaccugaaggaggagcaggaccagcaguacaucugccgccgggacgugguggaccgcggcugggggaacggcugcggccucuucgggaagggcggggucgugaccugcgccaaguucuccugcagcggcaagaucaccgggaaccuggugcagaucgagaaccuggaguacaccgucguggugacgguccacaacggcgacacccacgcggugggcaacgacaccuccaaccacggggugaccgccacgaucacgccccggagccccuccgucgaggugaagcucccggacuacggcgagcugacccuggacugcgagccccgcagcgggaucgacuucaacgagaugauccucaugaagaugaagaagaagaccuggcuggugcacaagcagugguuccuggaccucccccugcccuggaccgccggcgccgacaccuccgagguccacuggaacuacaaggagcggauggugaccuucaaggugccgcacgcgaagcgccaggacgucaccgugcuggggagccaggagggcgccaugcacuccgcccucgccggcgccacggaggucgacagcggggacggcaaccacauguucgcggggcaccugaagugcaaggugcggauggagaagcugcgcaucaagggcauguccuacaccaugugcagcgggaaguucuccaucgacaaggagauggccgagacccagcacggcaccacgguggucaaggugaaguacgagggcgccggggcccccugcaaggugcccaucgagauccgggacgucaacaaggagaagguggugggccgcgucaucagcuccacgccccucgccgagaacaccaacagcgugaccaacaucgagcuggagccgcccuucggggacuccuacaucgugaucggcgucgggaacagcgcgcugacccuccacugguuccggaag

SEQ ID NO: 1493 - RNA, 1272 nt, Artificial Sequence
  derived and/or modified CDS sequence (opt1) from DENV-4 Consensus__EdelTM-variant (aa1-424)
augcgcugcgugggcgucgggaaccgggacuucguggagggcgugagcgggggcgccugggucgaccuggugcucgagcacgggggcugcgugaccaccauggcccagggcaagcccacgcuggacuucgagcugaccaagaccaccgcgaaggaggucgcccuccugcgcacguacugcaucgaggccuccaucagcaacaucaccaccgccacccggugcccgacgcagggggagcccuaccugaaggaggagcaggaccagcaguacaucugccgccgggacgugguggaccgcggcugggggaacggcugcggccucuucgggaagggcggggucgugaccugcgccaaguucuccugcagcggcaagaucaccgggaaccuggugcagaucgagaaccuggaguacaccgucguggugacgguccacaacggcgacacccacgcggugggcaacgacaccuccaaccacggggugaccgccacgaucacgccccggagccccuccgucgaggugaagcucccggacuacggcgagcugacccuggacugcgagccccgcagcgggaucgacuucaacgagaugauccucaugaagaugaagaagaagaccuggcuggugcacaagcagugguuccuggaccucccccugcccuggaccgccggcgccgacaccuccgagguccacuggaacuacaaggagcggauggugaccuucaaggugccgcacgcgaagcgccaggacgucaccgugcuggggagccaggagggcgccaugcacuccgcccucgccggcgccacggaggucgacagcggggacggcaaccacauguucgcggggcaccugaagugcaaggugcggauggagaagcugcgcaucaagggcauguccuacaccaugugcagcgggaaguucuccaucgacaaggagauggccgagacccagcacggcaccacgguggucaaggugaaguacgagggcgccggggcccccugcaaggugcccaucgagauccgggacgucaacaaggagaagguggugggccgcgucaucagcuccacgccccucgccgagaacaccaacagcgugaccaacaucgagcuggagccgcccuucggggacuccuacaucgugaucggcgucgggaacagcgcgcugacccuccacugguuccggaagggcagcuccaucggcaagauguucgagagcaccuaccgcggggccaagcggauggccauccugggcgagaccgccugggacuucgggucc

SEQ ID NO: 1494 - RNA, 1266 nt, Artificial Sequence
  derived and/or modified CDS sequence (opt1) from DENV-4 Consensus__EdelTM-variant (aa1-421)
augcgcugcgugggcgucgggaaccgggacuucguggagggcgugagcgggggcgccugggucgaccuggugcucgagcacgggggcugcgugaccaccauggcccagggcaagcccacgcuggacuucgagcugaccaagaccaccgcgaaggaggucgcccuccugcgcacguacugcaucgaggccuccaucagcaacaucaccaccgccacccggugcccgacgcagggggagcccuaccugaaggaggagcaggaccagcaguacaucugccgccgggacgugguggaccgcggcugggggaacggcugcggccucuucgggaagggcggggucgugaccugcgccaaguucuccugcagcggcaagaucaccgggaaccuggugcagaucgagaaccuggaguacaccgucguggugacgguccacaacggcgacacccacgcggugggcaacgacaccuccaaccacggggugaccgccacgaucacgccccggagccccuccgucgaggugaagcucccggacuacggcgagcugacccuggacugcgagccccgcagcgggaucgacuucaacgagaugauccucaugaagaugaagaagaagaccuggcuggugcacaagcagugguuccuggaccucccccugcccuggaccgccggcgccgacaccuccgagguccacuggaacuacaaggagcggauggugaccuucaaggugccgcacgcgaagcgccaggacgucaccgugcuggggagccaggagggcgccaugcacuccgcccucgccggcgccacggaggucgacagcggggacggcaaccacauguucgcggggcaccugaagugcaaggugcggauggagaagcugcgcaucaagggcauguccuacaccaugugcagcgggaaguucuccaucgacaaggagauggccgagacccagcacggcaccacgguggucaaggugaaguacgagggcgccggggcccccugcaaggugcccaucgagauccgggacgucaacaaggagaagguggugggccgcgucaucagcuccacgccccucgccgagaacaccaacagcgugaccaacaucgagcuggagccgcccuucggggacuccuacaucgugaucggcgucgggaacagcgcgcugacccuccacugguuccggaagggcagcuccaucggcaagauguucgagagcaccuaccgcggggccaagcggauggccauccugggcgagaccgccugggacuga

SEQ ID NO: 1495 - RNA, 2031 nt, Artificial Sequence
  derived and/or modified CDS sequence (opt1) from DENV-4 Consensus__SSc-prME
augagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggcgagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcacgccccuggcggagaacaccaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccucgugcuguggaucggcacgaacucccggaacaccagcauggccaugaccugcaucgccgugggcgggaucacccuguuccugggcuucacgguccaggccuga

SEQ ID NO: 1496 - RNA, 2031 nt, Artificial Sequence
  derived and/or modified CDS sequence (opt1) from DENV-4 Consensus__SSc-prME(F108S)
augagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggcgagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguccgggaagggcgggguggugacgugcgccaaguucagcugcuccggcaagaucaccgggaaccugguccagaucgagaaccucgaguacaccgugguggucaccgugcacaacggcgacacgcacgccgucggcaacgacaccagcaaccacggggugaccgccaccaucacgccccgcucccccagcguggaggucaagcugccggacuacggcgagcugacccucgacugcgagccccgguccgggaucgacuucaacgagaugauccugaugaagaugaagaagaagaccuggcuggugcacaagcagugguuccucgaccugccccugcccuggaccgccggcgcggacaccagcgaggugcacuggaacuacaaggagcgcauggucacguucaaggugccgcacgccaagcggcaggacgugaccguccucgggagccaggagggcgccaugcacuccgcccuggccggcgcgaccgagguggacagcggggacggcaaccacauguucgccgggcaccugaagugcaaggugcgcauggagaagcuccgcaucaagggcauguccuacaccaugugcagcggcaaguucuccaucgacaaggagauggccgagacgcagcacgggaccaccgucgugaaggugaaguacgagggcgccggggcccccugcaagguccccaucgagauccgggacgugaacaaggagaagguggucggccgcgugaucagcuccacgccccuggcggagaacaccaacagcgugaccaacaucgagcuggagccgcccuucggggacuccuacaucgucaucggcgugggcaacagcgcccucacccugcacugguuccggaagggguccagcaucggcaagauguucgaguccaccuaccgcggggccaagcggauggccauccugggcgagacggcgugggacuucgggagcgugggcggccucuucaccucccuggggaaggccguccaccagguguucggcagcguguacaccaccauguucgggggcgucuccuggaugauccgcauccugaucggguuccucgugcuguggaucggcacgaacagccggaacaccuccauggccaugaccugcaucgccgugggcgggaucacccuguuccugggcuucacgguccaggccuga

SEQ ID NO: 1497 - RNA, 2031 nt, Artificial Sequence
  derived and/or modified CDS sequence (opt1) from DENV-4 Consensus__SSc-prMEdelstem_TM-JEV
augagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggcgagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcacgccccuggcggagaacaccaacuccgugaccaacaucgagcuggagccgcccuucggggacagcuacaucgucaucggcgugggcaacuccgcccucacccugcacugguuccggaaggggagcacccugggcaaggccuucuccacgacccucaagggggcccagcgccuggcggcccugggcgacaccgccugggacuucgggagcaucggcggcguguucaacuccaucgggcgggccguccaccagguguucggcggggccuuccgcacccucuucggcgggaugagcuggaucacgcagggccugaugggcgcgcugcugcucuggaugggggugaacgcccgggaccgcuccaucgcccuggccuuccuggccaccggcgggguccucguguuccuggcgaccaacgugcacgccuga

SEQ ID NO: 1498 - RNA, 1332 nt, Artificial Sequence
  derived and/or modified CDS sequence (opt1) from DENV-4 Consensus__SSm-EdelTM
augauccagcgcaccguguucuucguccugaugaugcucguggcccccagcuacggcaugcggugcgugggggucggcaaccgcgacuucguggaggggguguccggcggggccugggucgaccuggugcuggagcacggcggcugcgugaccacgauggcgcaggggaagcccacccucgacuucgagcugaccaagaccacggccaaggaggucgcccugcuccggaccuacugcaucgaggccagcaucuccaacaucaccaccgccacgcgcugccccacccagggcgagcccuaccugaaggaggagcaggaccagcaguacaucugccggcgcgacgugguggaccggggguggggcaacgggugcggccuguucggcaagggcggggucgugaccugcgcgaaguucagcugcuccgggaagaucaccggcaaccucgugcagaucgagaaccuggaguacacggucguggugaccguccacaacggcgacacccacgccguggggaacgacaccagcaaccacggcgugacggccaccaucacgccccgcuccccgagcgucgaggugaagcugcccgacuacggggagcucacccuggacugcgagccccgguccggcaucgacuucaacgagaugauccugaugaagaugaagaagaagaccuggcucgugcacaagcagugguuccuggaccugccccucccguggaccgccggggcggacaccagcgagguccacuggaacuacaaggagcgcauggugaccuucaaggucccccacgccaagcggcaggacgugacggugcugggcucccaggagggcgccaugcacagcgcccuggccggggcgaccgaggucgacuccggcgacgggaaccacauguucgccggccaccucaagugcaaggugcgcauggagaagcugcggaucaaggggaugagcuacaccaugugcuccggcaaguucagcaucgacaaggagauggccgagacccagcacggcacgaccguggucaaggugaaguacgagggggccggcgcccccugcaaggugcccaucgagauccgcgacgucaacaaggagaaggugguggggcgggucaucuccagcaccccgcuggcggagaacaccaacuccgugacgaacaucgagcucgagccgcccuucggcgacagcuacaucgugaucggggucggcaacagcgcccugacccugcacugguuccgcaagggcuccagcaucgggaagauguucgaguccaccuaccggggcgccaagcgcauggccauccucggggagaccgccugggacuucggcagcuga

SEQ ID NO: 1499 - RNA, 2376 nt, Artificial Sequence
  derived and/or modified CDS sequence (opt1) from DENV-4 Consensus__C-P2A-SSc-prME
augaaccagcgcaagaaggugguccggcccccguucaacaugcugaagcgcgagcggaaccgcgugagcacgccccagggccucgugaagcgguucuccaccgggcuguucagcggcaaggggccccugcgcaugguccucgccuucaucaccuuccugcgggugcuguccaucccgcccaccgccggcauccucaagcgcugggggcagcugaagaagaacaaggcgaucaagauccugaucggcuuccggaaggagaucggccgcaugcucaacauccugaacgggcggaagcgcaacuucgaccugcucaagcuggccggcgacguggagagcaaccccgggcccuccaccaucacccugcucugccugauccccacggucauggccuuccaccugagcacccgggacggcgagccgcucaugaucguggccaagcacgagcgcgggcggccccugcuguucaagaccaccgagggcaucaacaagugcacgcucaucgccauggaccugggcgagaugugcgaggacaccgugaccuacaagugcccccugcucgucaacaccgagcccgaggacaucgacugcuggugcaaccugacguccaccugggugauguacgggaccugcacccagagcggcgagcgccggcgcgagaagcgguccguggcgcugacgccgcacagcgggaugggccucgagacccgcgccgagaccuggauguccagcgagggcgccuggaagcacgcccagcgggucgaguccuggauccugcgcaaccccggguucgcgcugcucgccggcuucauggccuacaugaucgggcagaccggcauccagcgcacgguguucuucgugcugaugaugcuggucgcccccagcuacgggaugcggugcgugggcgugggcaaccgcgacuucgucgaggggguguccggcggggccuggguggaccucguccuggagcacggcgggugcgugaccaccauggcgcagggcaagcccacccuggacuucgagcucacgaagaccaccgccaaggagguggcccugcugcggaccuacugcaucgaggccagcaucuccaacaucacgaccgccacccgcugcccgacccagggcgagcccuaccucaaggaggagcaggaccagcaguacaucugccggcgcgacgucguggaccggggguggggcaacgggugcggccuguucgggaagggcggcgucgugacgugcgcgaaguucagcugcuccgggaagaucaccggcaaccuggugcagaucgagaaccucgaguacaccgucguggugaccguccacaacggggacacgcacgccgugggcaacgacaccagcaaccacggcgugaccgccaccaucacgccccgcagccccuccgucgaggugaagcugccggacuacggggagcugacccucgacugcgagccccggagcggcaucgacuucaacgagaugauccugaugaagaugaagaagaagaccuggcuggugcacaagcagugguuccucgaccugccccugcccuggaccgccggggccgacaccuccgagguccacuggaacuacaaggagcgcauggugacguucaaggugccgcacgcgaagcggcaggacgucaccgugcugggcagccaggagggggccaugcacuccgcccucgccggcgccaccgagguggacagcggcgacgggaaccacauguucgcgggccaccugaagugcaagguccgcauggagaagcugcggaucaaggggauguccuacaccaugugcagcggcaaguucuccaucgacaaggagauggccgagacgcagcacgggaccaccguggugaaggucaaguacgagggcgccggcgcccccugcaaggugcccaucgagauccgcgacgugaacaaggagaaggucguggggcgggugaucagcuccacgccccucgcggagaacaccaacagcgucaccaacaucgagcuggagccgcccuucggcgacuccuacaucgugaucggggugggcaacagcgcccugacccuccacugguuccgcaagggguccagcaucggcaagauguucgaguccaccuaccggggcgccaagcgcauggccauccugggggagacggccugggacuucggcagcgucgggggccuguucaccucccucgggaaggcggugcaccagguguucggcagcgucuacaccaccauguucggcggggugagcuggaugauccggauccugaucggcuuccuggugcucuggaucgggacgaacucccgcaacaccagcauggccaugaccugcaucgccgucggcggcaucacccuguuccugggguucacggugcaggccuga

SEQ ID NO: 1500 - RNA, 2043 nt, Artificial Sequence
  derived and/or modified CDS sequence (opt1) from DENV-4 Consensus__SSopt-prME(F108S)
augaagcgcaagaaguccaccaucacccugcucugccugauccccacggugauggccuuccaccugagcacccgggacggcgagccgcucaugaucgucgccaagcacgagcgcgggcggccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggggagcgccggcgcgagaagcggagcguggcccugacgccgcacuccggcaugggccucgagacccgcgccgagaccuggaugagcuccgagggggccuggaagcacgcccagcggguggagagcuggauccugcgcaaccccggcuucgcgcugcucgccggguucauggccuacaugaucggccagaccgggauccagcggacggucuucuucgugcugaugaugcugguggcccccuccuacggcaugcgcugcgucggcguggggaaccgggacuucguggagggcgucagcgggggcgcguggguggaccucgugcuggagcacggcgggugcgucaccaccauggcccagggcaagcccacccuggacuucgagcucacgaagaccaccgccaaggagguggcccugcugcgcaccuacugcaucgaggccuccaucagcaacaucacgaccgcgacccggugcccgacccagggggagcccuaccucaaggaggagcaggaccagcaguacaucugccgccgggacguggucgaccgcggcugggggaacggcugcggccuguccgggaagggcgggguggugacgugcgccaaguucagcugcuccggcaagaucaccgggaaccugguccagaucgagaaccucgaguacaccgugguggucaccgugcacaacggcgacacgcacgccgucggcaacgacaccagcaaccacggggugaccgccaccaucacgccccggucccccagcguggaggucaagcugccggacuacggcgagcugacccucgacugcgagccccgcuccgggaucgacuucaacgagaugauccugaugaagaugaagaagaagaccuggcuggugcacaagcagugguuccucgaccugccccugcccuggaccgccggcgcggacaccagcgaggugcacuggaacuacaaggagcggauggucacguucaaggugccgcacgccaagcgccaggacgugaccguccucgggagccaggagggcgccaugcacuccgcccuggccggcgcgaccgagguggacagcggggacggcaaccacauguucgccgggcaccugaagugcaaggugcgcauggagaagcuccggaucaagggcauguccuacaccaugugcagcggcaaguucuccaucgacaaggagauggccgagacgcagcacgggaccaccgucgugaaggugaaguacgagggcgccggggcccccugcaagguccccaucgagauccgcgacgugaacaaggagaagguggucggccgggugaucagcuccacgccccuggcggagaacaccaacagcgugaccaacaucgagcuggagccgcccuucggggacuccuacaucgucaucggcgugggcaacagcgcccucacccugcacugguuccgcaagggguccagcaucggcaagauguucgaguccaccuaccggggcgccaagcgcauggccauccugggcgagacggcgugggacuucgggagcgugggcggccucuucaccucccuggggaaggccguccaccagguguucggcagcguguacaccaccauguucgggggcgucuccuggaugauccggauccugaucggguuccucgugcuguggaucggcacgaacagccgcaacaccuccauggccaugaccugcaucgccgugggcgggaucacccuguuccugggcuucacgguccaggccuga

SEQ ID NO: 1501 - RNA, 2043 nt, Artificial Sequence
  derived and/or modified CDS sequence (opt1) from DENV-4 Consensus__SSopt-prME(V96H)
augaagcgcaagaaguccaccaucacccugcucugccugauccccacggugauggccuuccaccugagcacccgggacggcgagccgcucaugaucgucgccaagcacgagcgcgggcggccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggggagcgccggcgcgagaagcggagcguggcccugacgccgcacuccggcaugggccucgagacccgcgccgagaccuggaugagcuccgagggggccuggaagcacgcccagcggguggagagcuggauccugcgcaaccccggcuucgcgcugcucgccggguucauggccuacaugaucggccagaccgggauccagcggacggucuucuucgugcugaugaugcugguggcccccuccuacggcaugcgcugcgucggcguggggaaccgggacuucguggagggcgucagcgggggcgcguggguggaccucgugcuggagcacggcgggugcgucaccaccauggcccagggcaagcccacccuggacuucgagcucacgaagaccaccgccaaggagguggcccugcugcgcaccuacugcaucgaggccuccaucagcaacaucacgaccgcgacccggugcccgacccagggggagcccuaccucaaggaggagcaggaccagcaguacaucugccgccgggaccacguggaccgcggcugggggaacggcugcggccuguucgggaagggcggggucgugacgugcgccaaguucuccugcagcggcaagaucaccgggaaccuggugcagaucgagaaccucgaguacaccgucguggugaccguccacaacggcgacacgcacgccgugggcaacgacaccuccaaccacggggucaccgccaccaucacgccccggagccccuccguggaggugaagcugccggacuacggcgagcugacccucgacugcgagccccgcagcgggaucgacuucaacgagaugauccugaugaagaugaagaagaagaccuggcugguccacaagcagugguuccucgaccugccccugcccuggaccgccggcgcggacaccuccgaggugcacuggaacuacaaggagcggauggugacguucaaggucccgcacgccaagcgccaggacgugaccgugcucgggagccaggagggcgccaugcacagcgcccuggccggcgcgaccgaggucgacuccggggacggcaaccacauguucgccgggcaccugaagugcaaggugcgcauggagaagcuccggaucaagggcaugagcuacaccaugugcuccggcaaguucagcaucgacaaggagauggccgagacgcagcacgggaccaccguggucaaggugaaguacgagggcgccggggcccccugcaaggugcccaucgagauccgcgacgucaacaaggagaagguggugggccgggucaucuccagcacgccccuggcggagaacaccaacuccgugaccaacaucgagcuggagccgcccuucggggacagcuacaucgugaucggcgucggcaacuccgcccucacccugcacugguuccgcaaggggagcuccaucggcaagauguucgagagcaccuaccggggcgccaagcgcauggccauccugggcgagacggcgugggacuucggguccgugggcggccucuucaccagccuggggaaggccgugcaccaggucuucggcuccguguacaccaccauguucgggggcgugagcuggaugauccggauccugaucggguuccucguccuguggaucggcacgaacucccgcaacaccagcauggccaugaccugcaucgccgugggcgggaucacccuguuccugggcuucacggugcaggccuga

SEQ ID NO: 1502 - RNA, 2043 nt, Artificial Sequence
  derived and/or modified CDS sequence (opt1) from DENV-4 Consensus__SSopt-prME(E186F)
augaagcgcaagaaguccaccaucacccugcucugccugauccccacggugauggccuuccaccugagcacccgggacggcgagccgcucaugaucgucgccaagcacgagcgcgggcggccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggggagcgccggcgcgagaagcggagcguggcccugacgccgcacuccggcaugggccucgagacccgcgccgagaccuggaugagcuccgagggggccuggaagcacgcccagcggguggagagcuggauccugcgcaaccccggcuucgcgcugcucgccggguucauggccuacaugaucggccagaccgggauccagcggacggucuucuucgugcugaugaugcugguggcccccuccuacggcaugcgcugcgucggcguggggaaccgggacuucguggagggcgucagcgggggcgcguggguggaccucgugcuggagcacggcgggugcgucaccaccauggcccagggcaagcccacccuggacuucgagcucacgaagaccaccgccaaggagguggcccugcugcgcaccuacugcaucgaggccuccaucagcaacaucacgaccgcgacccggugcccgacccagggggagcccuaccucaaggaggagcaggaccagcaguacaucugccgccgggacguggucgaccgcggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccggagccccuccguggaggucaagcugccggacuacggcgagcugacccucgacugcuucccccgcagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcggauggucacguucaaggugccgcacgccaagcgccaggacgugaccguccucgggagccaggagggcgccaugcacagcgcccuggccggcgcgaccgagguggacuccggggacggcaaccacauguucgccgggcaccugaagugcaaggugcgcauggagaagcuccggaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgcgacgugaacaaggagaagguggucggccgggugaucuccagcacgccccuggcggagaacaccaacuccgugaccaacaucgagcuggagccgcccuucggggacagcuacaucgucaucggcgugggcaacuccgcccucacccugcacugguuccgcaaggggagcuccaucggcaagauguucgagagcaccuaccggggcgccaagcgcauggccauccugggcgagacggcgugggacuucggguccgugggcggccucuucaccagccuggggaaggccguccaccagguguucggcuccguguacaccaccauguucgggggcgucagcuggaugauccggauccugaucggguuccucgugcuguggaucggcacgaacucccgcaacaccagcauggccaugaccugcaucgccgugggcgggaucacccuguuccugggcuucacgguccaggccuga

SEQ ID NO: 1503 - RNA, 2043 nt, Artificial Sequence
  derived and/or modified CDS sequence (opt1) from DENV-4 Consensus__SSopt-prME(R188L)
augaagcgcaagaaguccaccaucacccugcucugccugauccccacggugauggccuuccaccugagcacccgggacggcgagccgcucaugaucgucgccaagcacgagcgcgggcggccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggcgagcgccggcgcgagaagcggagcguggcccugacgccgcacuccggcaugggccucgagacccgcgccgagaccuggaugagcuccgagggggccuggaagcacgcccagcggguggagagcuggauccugcgcaaccccggcuucgcgcugcucgccggguucauggccuacaugaucggccagaccgggauccagcggacggucuucuucgugcugaugaugcugguggcccccuccuacggcaugcgcugcgucggcguggggaaccgggacuucguggagggcgucagcgggggcgcguggguggaccucgugcuggagcacggcgggugcgucaccaccauggcccagggcaagcccacccuggacuucgagcucacgaagaccaccgccaaggagguggcccugcugcgcaccuacugcaucgaggccuccaucagcaacaucacgaccgcgacccggugcccgacccagggggagcccuaccucaaggaggagcaggaccagcaguacaucugccgccgggacguggucgaccgcggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccggagccccuccguggaggucaagcugccggacuacggcgagcugacccucgacugcgagccccugagcgggaucgacuucaacgagaugauccugaugaagaugaagaagaagaccuggcucgugcacaagcagugguuccuggaccugccccuccccuggaccgccggcgcggacaccuccgaggugcacuggaacuacaaggagcgcauggucacguucaaggugccgcacgccaagcggcaggacgugaccguccuggggagccaggagggcgccaugcacagcgcccuggccggcgcgaccgagguggacuccggggacggcaaccacauguucgccgggcaccucaagugcaaggugcgcauggagaagcugcgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcacgccccuggcggagaacaccaacuccgugaccaacaucgagcucgagccgcccuucggggacagcuacaucgucaucggcgugggcaacuccgcccugacccugcacugguuccggaaggggagcuccaucggcaagauguucgagagcaccuaccgcggggccaagcggauggccauccucggcgagacggcgugggacuucggguccgugggcggccuguucaccagccuggggaaggccguccaccagguguucggcuccguguacaccaccauguucgggggcgucagcuggaugauccgcauccucaucggguuccuggugcuguggaucggcacgaacucccggaacaccagcauggccaugaccugcaucgccgugggcgggaucacccuguuccucggcuucacgguccaggccuga

SEQ ID NO: 1504 - RNA, 2043 nt, Artificial Sequence
  derived and/or modified CDS sequence (opt1) from DENV-4 Consensus__SSopt-pr(D104A)MEdelstem_TM,(F108S)-JEV
augaagcgcaagaaguccaccaucacccugcucugccugauccccacggugauggccuuccaccugagcacccgggacggcgagccgcucaugaucgucgccaagcacgagcgcgggcggccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggcgagcgccggcgcgccaagcggagcguggcccugacgccgcacuccggcaugggccucgagacccgcgccgagaccuggaugagcuccgagggggccuggaagcacgcgcagcggguggagagcuggauccugcgcaaccccggcuucgcccugcucgccggguucauggccuacaugaucggccagaccgggauccagcggacggucuucuucgugcugaugaugcugguggcgcccuccuacggcaugcgcugcgucggcguggggaaccgggacuucguggagggcgucagcgggggcgccuggguggaccucgugcuggagcacggcgggugcgucaccaccauggcccagggcaagcccacccuggacuucgagcucacgaagaccaccgccaaggagguggcccugcugcgcaccuacugcaucgaggcguccaucagcaacaucacgaccgccacccggugcccgacccagggggagcccuaccucaaggaggagcaggaccagcaguacaucugccgccgggacguggucgaccgcggcugggggaacggcugcggccuguccgggaagggcgggguggugacgugcgccaaguucagcugcuccggcaagaucaccgggaaccugguccagaucgagaaccucgaguacaccgugguggucaccgugcacaacggcgacacgcacgccgucggcaacgacaccagcaaccacggggugaccgccaccaucacgccccggucccccagcguggaggucaagcugccggacuacggcgagcugacccucgacugcgagccccgcuccgggaucgacuucaacgagaugauccugaugaagaugaagaagaagaccuggcuggugcacaagcagugguuccucgaccugccccugcccuggaccgcgggcgccgacaccagcgaggugcacuggaacuacaaggagcggauggucacguucaaggugccgcacgccaagcgccaggacgugaccguccucgggagccaggagggcgccaugcacuccgcccuggcgggcgccaccgagguggacagcggggacggcaaccacauguucgccgggcaccugaagugcaaggugcgcauggagaagcuccggaucaagggcauguccuacaccaugugcagcggcaaguucuccaucgacaaggagauggccgagacgcagcacgggaccaccgucgugaaggugaaguacgagggcgccggggcgcccugcaagguccccaucgagauccgcgacgugaacaaggagaagguggucggccgggugaucagcuccacgccccuggccgagaacaccaacagcgugaccaacaucgagcuggagccgcccuucggggacuccuacaucgucaucggcgugggcaacagcgcccucacccugcacugguuccgcaagggguccacccugggcaaggccuucagcacgacccucaagggggcgcagcggcuggccgcccugggcgacaccgccugggacuucggguccaucggcggcguguucaacagcaucgggcgcgccguccaccagguguucggcggggcguuccggacccucuucggcgggauguccuggaucacgcagggccugaugggcgcccugcugcucuggaugggggugaacgcccgcgaccggagcaucgcccuggccuuccuggcgaccggcgggguccucguguuccuggccaccaacgugcacgccuga

SEQ ID NO: 1505 - RNA, 2043 nt, Artificial Sequence
  derived and/or modified CDS sequence (opt1) from DENV-4 Consensus__SSopt-prMEdelstem_TM,(H261N)-JEV
augaagcgcaagaaguccaccaucacccugcucugccugauccccacggugauggccuuccaccugagcacccgggacggcgagccgcucaugaucgucgccaagcacgagcgcgggcggccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggcgagcgccggcgcgagaagcggagcguggcccugacgccgcacuccggcaugggccucgagacccgcgccgagaccuggaugagcuccgagggggccuggaagcacgcccagcggguggagagcuggauccugcgcaaccccggcuucgcgcugcucgccggguucauggccuacaugaucggccagaccgggauccagcggacggucuucuucgugcugaugaugcugguggcccccuccuacggcaugcgcugcgucggcguggggaaccgggacuucguggagggcgucagcgggggcgcguggguggaccucgugcuggagcacggcgggugcgucaccaccauggcccagggcaagcccacccuggacuucgagcucacgaagaccaccgccaaggagguggcccugcugcgcaccuacugcaucgaggccuccaucagcaacaucacgaccgcgacccggugcccgacccagggggagcccuaccucaaggaggagcaggaccagcaguacaucugccgccgggacguggucgaccgcggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccggagccccuccguggaggucaagcugccggacuacggcgagcugacccucgacugcgagccccgcagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcggauggucacguucaaggugccgcacgccaagcgccaggacgugaccguccucgggagccaggagggcgccaugaacagcgcccuggccggcgcgaccgagguggacuccggggacggcaaccacauguucgccgggcaccugaagugcaaggugcgcauggagaagcuccggaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgcgacgugaacaaggagaagguggucggccgggugaucuccagcacgccccuggcggagaacaccaacuccgugaccaacaucgagcuggagccgcccuucggggacagcuacaucgucaucggcgugggcaacuccgcccucacccugcacugguuccgcaaggggagcacccugggcaaggccuucuccacgacccucaagggggcccagcggcuggcggcccugggcgacaccgccugggacuucgggagcaucggcggcguguucaacuccaucgggcgcgccguccaccagguguucggcggggccuuccggacccucuucggcgggaugagcuggaucacgcagggccugaugggcgcgcugcugcucuggaugggggugaacgcccgcgaccgguccaucgcccuggccuuccuggccaccggcgggguccucguguuccuggcgaccaacgugcacgccuga

SEQ ID NO: 1506 - RNA, 2043 nt, Artificial Sequence
  derived and/or modified CDS sequence (opt1) from DENV-4 Consensus__SSopt-prMEdelstem_TM,(R188L,A267T)-JEV
augaagcgcaagaaguccaccaucacccugcucugccugauccccacggugauggccuuccaccugagcacccgggacggcgagccgcucaugaucgucgccaagcacgagcgcgggcggccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacgggaccugcacccaguccggcgagcgccggcgcgagaagcggagcguggcccugacgccgcacuccggcaugggccucgagacccgcgccgagaccuggaugagcuccgagggggccuggaagcacgcccagcggguggagagcuggauccugcgcaaccccggcuucgcgcugcucgccggguucauggccuacaugaucggccagaccgggauccagcggacggucuucuucgugcugaugaugcugguggcccccuccuacggcaugcgcugcgucggcguggggaaccgggacuucguggagggcgucagcgggggcgcguggguggaccucgugcuggagcacggcgggugcgucaccaccauggcccagggcaagcccacccuggacuucgagcucacgaagaccaccgccaaggagguggcccugcugcgcaccuacugcaucgaggccuccaucagcaacaucacgaccgcgacccggugcccgacccagggggagcccuaccucaaggaggagcaggaccagcaguacaucugccgccgggacguggucgaccgcggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccggagccccuccguggaggucaagcugccggacuacggcgagcugacccucgacugcgagccccugagcgggaucgacuucaacgagaugauccugaugaagaugaagaagaagaccuggcucgugcacaagcagugguuccuggaccugccccuccccuggaccgccggcgcggacaccuccgaggugcacuggaacuacaaggagcgcauggucacguucaaggugccgcacgccaagcggcaggacgugaccguccuggggagccaggagggcgccaugcacagcgcccuggccggcaccaccgagguggacuccggggacggcaaccacauguucgcggggcaccucaagugcaaggugcgcauggagaagcugcgcaucaagggcaugagcuacacgaugugcuccggcaaguucagcaucgacaaggagauggccgagacccagcacgggaccaccgucgugaaggugaaguacgagggcgccggggcccccugcaagguccccaucgagauccgggacgugaacaaggagaagguggucggccgcgugaucuccagcacgccccuggccgagaacaccaacuccgugaccaacaucgagcucgagccgcccuucggggacagcuacaucgucaucggcgugggcaacuccgcgcugacccugcacugguuccggaaggggagcacgcucggcaaggccuucuccaccacccugaagggggcccagcgccuggccgcgcucggcgacaccgccugggacuucgggagcaucggcggcguguucaacuccaucgggcgggccguccaccagguguucggcggggccuuccgcacgcuguucggcgggaugagcuggaucacccagggccugaugggcgcccugcuccuguggaugggggugaacgcgcgggaccgcuccaucgcccuggccuuccucgccaccggcgggguccugguguuccuggccaccaacgugcacgcguga

SEQ ID NO: 1507 - RNA, 300 nt, Artificial Sequence
  derived and/or modified CDS sequence (opt1) from DENV-3 Consensus__C
augaacaaccagcgcaagaagaccggcaagcccagcaucaacaugcugaagcgggugcgcaaccgggucuccaccgggagccagcucgccaagcgcuucuccaagggccugcugaacgggcagggccccaugaagcucgugauggccuucaucgcguuccugcgguuccuggccaucccgcccacggccggggugcucgcccgcuggggcaccuucaagaaguccggcgccaucaagguccugaagggguucaagaaggagaucagcaacaugcugagcaucaucaacaagcggaagaag

SEQ ID NO: 1508 - RNA, 342 nt, Artificial Sequence
  derived and/or modified CDS sequence (opt1) from DENV-3 Consensus__C-SSc
augaacaaccagcgcaagaagaccggcaagcccagcaucaacaugcugaagcgggugcgcaaccgggucuccaccgggagccagcucgccaagcgcuucuccaagggccugcugaacgggcagggccccaugaagcucgugauggccuucaucgcguuccugcgguuccuggccaucccgcccacggccggggugcucgcccgcuggggcaccuucaagaaguccggcgccaucaagguccugaagggguucaagaaggagaucagcaacaugcugagcaucaucaacaagcggaagaagaccucccucugccugaugaugauccugcccgcggcccucgcc

SEQ ID NO: 1509 - RNA, 273 nt, Artificial Sequence
  derived and/or modified CDS sequence (opt1) from DENV-3 Consensus__pr
uuccaccugaccagccgcgacggcgagccccggaugaucguggggaagaacgagcgcggcaagucccuccuguucaagaccgccagcgggaucaacaugugcacgcugaucgccauggaccucggcgagaugugcgacgacaccgucaccuacaagugcccgcacaucaccgagguggagcccgaggacaucgacugcuggugcaaccugacguccaccugggugaccuacgggaccugcaaccaggcgggcgagcaccggcgcgacaagcgg

SEQ ID NO: 1510 - RNA, 225 nt, Artificial Sequence
  derived and/or modified CDS sequence (opt1) from DENV-3 Consensus__M
agcguggcccuggcgccccacgucggcauggggcucgacacccgcacccagacguggauguccgccgagggcgccuggcgccagguggagaagguggagaccugggcccugcggcacccgggguucaccauccuggcccucuuccuggcccacuacaucggcaccagccugacgcagaaggucgugaucuucauccuccugaugcuggugacccccuccaugacc

SEQ ID NO: 1511 - RNA, 498 nt, Artificial Sequence
  derived and/or modified CDS sequence (opt1) from DENV-3 Consensus__prM
uuccaccugaccagccgcgacggcgagccccggaugaucguggggaagaacgagcgcggcaagucccuccuguucaagaccgccagcgggaucaacaugugcacgcugaucgccauggaccucggcgagaugugcgacgacaccgucaccuacaagugcccgcacaucaccgagguggagcccgaggacaucgacugcuggugcaaccugacguccaccugggugaccuacgggaccugcaaccaggcgggcgagcaccggcgcgacaagcggagcgucgcccuggcgccccacgugggcauggggcucgacacgcgcacccagaccuggauguccgccgagggcgccuggcgccagguggagaaggucgagaccugggcccugcggcaccccggguucacgauccuggcccucuuccuggcccacuacaucggcaccagccugacccagaagguggugaucuucauccuccugaugcuggucaccccguccaugacg

SEQ ID NO: 1512 - RNA, 1479 nt, Artificial Sequence
  derived and/or modified CDS sequence (opt1) from DENV-3 Consensus__E
augcgcugcgugggcgucgggaaccgggacuucguggagggccugagcggggccaccuggguggacgucgugcucgagcacggcgggugcgugaccacgauggccaagaacaagcccacccuggacaucgagcugcagaagaccgaggcgacccagcucgccacgcugcgcaagcugugcaucgagggcaagaucaccaacaucaccaccgacucccggugccccacgcagggcgaggccacccuccccgaggagcaggaccagaacuacgucugcaagcacaccuacguggaccgcggguggggcaacgggugcggccuguucgggaagggcagccuggugaccugcgccaaguuccagugccucgagcccaucgagggcaaggucgugcaguacgagaaccugaaguacacggugaucaucaccguccacaccggggaccagcaccaggugggcaacgagacccagggggugacggccgagaucacgccccaggcguccaccaccgaggccauccugccggaguacggcacccucggccuggagugcagcccccggaccgggcuggacuucaacgagaugauccuccugaccaugaagaacaaggccuggaugguccaccgccagugguucuucgaccugccccuccccuggaccuccggcgccacgaccgagaccccgaccuggaaccggaaggagcugcuggugacguucaagaacgcgcacgccaagaagcaggagguggucgugcucgggagccaggagggcgccaugcacaccgcccugaccggggccaccgagauccagaacuccggcggcacgagcaucuucgcggggcaccugaagugccgccucaagauggacaagcuggagcugaagggcauguccuacgccaugugcaccaacaccuucgugcucaagaaggaggucagcgagacccagcacgggacgauccugaucaagguggaguacaagggcgaggacgugcccugcaagauccccuucuccaccgaggacgggcagggcaaggcccacaacggccggcugaucaccgccaaccccgucgugaccaagaaggaggagccggucaacaucgaggccgagccgcccuucggggagagcaacaucgugaucggcaucggggacaacgcgcucaagaucaacugguacaagaagggcuccagcaucgggaagauguucgaggccaccgcccgcggcgcccggcgcauggccauccugggcgacacggcgugggacuucggguccgugggcgggguccugaacagccucggcaagauggugcaccagaucuucggcuccgccuacaccgcccuguucagcgggguguccugggucaugaagaucggcaucggggugcugcucaccuggaucggccugaacagcaagaacaccagcauguccuucagcugcaucgccaucgggaucaucacgcuguaccucggcgccgugguccaggcg

SEQ ID NO: 1513 - RNA, 1977 nt, Artificial Sequence
  derived and/or modified CDS sequence (opt1) from DENV-3 Consensus__prME
uuccaccugaccagccgcgacggcgagccccggaugaucguggggaagaacgagcgcggcaagucccuccuguucaagaccgccagcgggaucaacaugugcacgcugaucgccauggaccucggcgagaugugcgacgacaccgucaccuacaagugcccgcacaucaccgagguggagcccgaggacaucgacugcuggugcaaccugacguccaccugggugaccuacgggaccugcaaccaggcgggcgagcaccggcgcgacaagcggagcgucgcccuggcgccccacgugggcauggggcucgacacgcgcacccagaccuggauguccgccgagggcgccuggcgccagguggagaaggucgagaccugggcccugcggcaccccggguucacgauccuggcccucuuccuggcccacuacaucggcaccagccugacccagaagguggugaucuucauccuccugaugcuggucaccccguccaugacgaugcggugcgugggggugggcaaccgcgacuucgucgagggccucagcggggccaccuggguggacgugguccuggagcacggcgggugcgugaccaccauggcgaagaacaagcccacgcuggacaucgagcuccagaagaccgaggccacccagcuggccacccugcggaagcucugcaucgagggcaagaucacgaacaucaccaccgacucccgcugccccacccagggcgaggccacgcugcccgaggagcaggaccagaacuacgugugcaagcacaccuacgucgaccggggguggggcaacgggugcggccuguucgggaagggcagccucgugaccugcgccaaguuccagugccuggagccgaucgagggcaaggugguccaguacgagaaccugaaguacaccgugaucaucacggugcacaccggggaccagcaccaggucggcaacgagacccagggggugaccgcggagaucacgccccaggccuccaccaccgaggccauccuccccgaguacggcacccuggggcuggagugcagcccccgcaccggccucgacuucaacgagaugauccugcugacgaugaagaacaaggccuggaugguccaccggcagugguucuucgaccucccgcugcccuggaccuccggcgccaccaccgagacgcccaccuggaaccgcaaggagcugcucgugaccuucaagaacgcgcacgccaagaagcaggagguggucgugcuggggagccaggagggcgccaugcacaccgcccugacgggggccaccgagauccagaacuccggcgggaccagcaucuucgcgggccaccucaagugccggcugaagauggacaagcuggagcucaagggcauguccuacgccaugugcaccaacacguucgugcugaagaaggaggucagcgagacccagcacgggaccauccugaucaagguggaguacaagggcgaggacgugcccugcaagaucccguucuccaccgaggacgggcagggcaaggcccacaacggccgccucaucacggccaaccccgucgugaccaagaaggaggagcccgugaacaucgaggccgagcccccguucggggagagcaacaucgucaucggcaucggggacaacgcgcugaagaucaacugguacaagaagggcagcuccaucgggaagauguucgaggccaccgcccggggcgcccgccggauggcgauccugggcgacaccgccugggacuucgggagcgugggcggggugcucaacucccugggcaagaugguccaccagaucuucgggagcgccuacacggcccuguucuccggcgugagcugggugaugaagaucggcaucgggguccugcucaccuggaucggccugaacuccaagaacaccagcauguccuucagcugcaucgccaucgggaucaucacccuguaccucggcgcgguggugcaggcc

SEQ ID NO: 1514 - RNA, 2019 nt, Artificial Sequence
  derived and/or modified CDS sequence (opt1) from DENV-3 Consensus__SSc-prME
accagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcaccggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggcc

SEQ ID NO: 1515 - RNA, 1056 nt, Artificial Sequence
  derived and/or modified CDS sequence (opt1) from DENV-3 Consensus__NS1
gacaugggcugcgugaucaacuggaaggggaaggagcugaagugcggcagcgggaucuucgucaccaacgaggugcacaccuggacggagcaguacaaguuccaggccgacucccccaagcgccucgccaccgcgaucgccggcgccugggagaacggggugugcggcauccggagcaccacccgcauggagaaccugcuguggaagcagaucgccaacgagcucaacuacauccugugggagaacaacaucaagcugacggucguggugggcgacaucaucgggguccucgagcagggcaagcggacccugaccccgcagcccauggagcugaaguacuccuggaagaccugggggaaggccaagaucgugacggcggagacccagaacagcuccuucaucaucgacggccccaacacccccgagugcccgagcgugucccgcgccuggaacgucugggagguggaggacuacggguucggcguguucaccacgaacaucuggcucaagcugcgggaggucuacacccagcugugcgaccaccgccucaugagcgccgccgugaaggacgagcgggcggugcacgccgacaugggcuacuggaucgagucccagaagaacgggagcuggaagcuggagaaggccucccugaucgaggucaagaccugcaccuggcccaagagccacacgcucugguccaacggcgugcuggagagcgacaugaucauccccaagucccuggccgggcccaucagccagcacaaccaccgcccgggcuaccacacccagaccgccggccccuggcaccucgggaagcuggagcuggacuucaacuacugcgagggcaccacgguggucaucaccgagaacugcgggacccggggccccucccuccgcaccacgaccgugagcgggaagcugauccacgaguggugcugccgguccugcacccugcccccgcuccgcuacaugggcgaggacggcugcugguacgggauggagauccggcccaucagcgagaaggaggagaacauggucaagagccugguguccgcg

SEQ ID NO: 1516 - RNA, 1857 nt, Artificial Sequence
  derived and/or modified CDS sequence (opt1) from DENV-3 Consensus__NS3
agcggcgugcugugggacguccccuccccgcccgagacccagaaggccgagcucgaggaggggguguaccgcaucaagcagcagggcaucuucgggaagacccaggugggcgucggggugcagaaggagggcguguuccacacgauguggcacgucacccggggcgccgugcugaccuacaacgggaagcgccuggagcccaacugggcgagcgugaagaaggaccucaucuccuacggcgggggcuggcggcugagcgcccaguggcagaagggggaggagguccaggugaucgccguggagcccggcaagaacccgaagaacuuccagaccaugcccggcacguuccagaccaccaccggggagaucggcgccaucgcccuggacuucaagcccgggacguccggcagccccaucaucaaccgcgagggcaaggucguggggcucuacggcaacgggguggucaccaagaacggcggguacguguccggcaucgcgcagaccaacgccgagccggacggccccacccccgagcuggaggaggagauguucaagaagcggaaccugacgaucauggaccuccaccccgggagcggcaagacccgcaaguaccugccggccaucgugcgggaggccaucaagcgccggcugcgcacccucauccuggcgcccacccgggucguggccgccgagauggaggaggcccugaaggggcuccccauccgcuaccagacgaccgccaccaaguccgagcacaccggccgggagaucguggaccugaugugccacgcgacguucaccaugcgccugcucagccccguccgggugccgaacuacaaccugaucaucauggacgaggcccacuucaccgaccccgccuccaucgccgcccgcggguacaucagcacccgggugggcaugggcgaggcggccgccaucuucaugacggccaccccgcccgggaccgccgacgcguucccccaguccaacgcccccauccaggacgaggagcgcgacauccccgagcggagcuggaacuccggcaacgaguggaucaccgacuucgccgggaagacggucugguucgugcccagcaucaaggccggcaacgacaucgccaacugccugcgcaagaacgggaagaaggucauccagcucucccggaagaccuucgacaccgaguaccagaagaccaagcugaacgacugggacuucguggugacgaccgacaucagcgagaugggcgcgaacuucaaggccgaccgcgucaucgacccgcgccggugccugaagcccgugauccucaccgacggccccgagcgcgugauccuggccgggcccaugccggucaccgccgcguccgccgcccagcggcgcggccggguggggcgcaacccccagaaggagaacgaccaguacaucuucacgggccagccccugaacaacgacgaggaccacgcccacuggaccgaggccaagaugcuccuggacaacaucaacaccccggagggcaucauccccgcgcuguucgagcccgagcgggagaaguccgccgccaucgacggggaguaccgccucaagggcgagagccggaagaccuucguggagcugaugcgccgcggggaccugcccgucuggcucgcccacaagguggccagcgagggcaucaaguacaccgaccggaaguggugcuucgacgggcagcggaacaaccagauccuggaggagaacauggacguggagaucuggacgaaggagggcgagaagaagaagcugcgcccgcgguggcucgacgcgcgcaccuacagcgacccccuggcccugaaggaguucaaggaguucgccgccggccggaag

SEQ ID NO: 1517 - RNA, 2319 nt, Artificial Sequence
  derived and/or modified CDS sequence (opt1) from DENV-3 Consensus__C-prME
augaacaaccagcgcaagaagaccggcaagcccagcaucaacaugcugaagcgggugcgcaaccgggucuccaccgggagccagcucgccaagcgcuucuccaagggccugcugaacgggcagggcccgaugaagcucgugauggccuucaucgcguuccugcgguuccuggccaucccgcccacggccggggugcucgcccgcuggggcaccuucaagaaguccggcgccaucaagguccugaagggguucaagaaggagaucagcaacaugcugagcaucaucaacaagcggaagaagaccucccucugccugaugaugauccugcccgcggcccucgccuuccaccugaccagccgcgacggcgagccccggaugaucguggggaagaacgagcgcggcaagucccuccuguucaagacggccagcgggaucaacaugugcacccugaucgcgauggaccugggcgagaugugcgacgacaccgugaccuacaagugcccccacaucacggaggucgagcccgaggacaucgacugcuggugcaaccucaccuccaccugggugaccuacggcacgugcaaccaggccggggagcaccggcgcgacaagcggagcguggcccuggcgccccacgucggcauggggcuggacacccgcacccagaccuggauguccgccgagggcgccuggcggcaggucgagaagguggagacgugggcccuccgccacccgggcuucaccauccuggcccuguuccucgcccacuacaucgggaccagccugacccagaaggucgugaucuucauccugcucaugcuggugacgcccuccaugaccaugcggugcgucggcguggggaaccgcgacuucguggagggccugagcggggccaccugggucgacguggugcucgagcacggcggcugcgucaccacgauggcgaagaacaagcccacccuggacaucgagcugcagaagaccgaggccacccagcucgccacgcugcggaagcugugcaucgaggggaagaucaccaacaucaccaccgacucccgcugccccacgcagggcgaggccacccucccggaggagcaggaccagaacuacgugugcaagcacaccuacguggaccggggguggggcaacgggugcggccuguucggcaaggggagccuggugaccugcgccaaguuccagugccucgagcccaucgagggcaaggugguccaguacgagaaccugaaguacacggugaucaucaccgugcacaccggggaccagcaccaggucggcaacgagacccagggggugaccgcggagaucacgccccaggccuccaccaccgaggccauccugcccgaguacggcacccucggccuggagugcagcccgcgcacggggcuggacuucaacgagaugauccuccugaccaugaagaacaaggccuggauggugcaccgccagugguucuucgaccugccccuccccuggaccagcggcgccaccacggagacccccaccuggaaccggaaggagcugcuggucaccuucaagaacgcgcacgccaagaagcaggagguggugguccuggggucccaggagggcgccaugcacacggcccucaccggcgcgaccgagauccagaacagcgggggcaccuccaucuucgccgggcaccugaagugccgccugaagauggacaagcucgagcugaagggcaugagcuacgccaugugcacgaacaccuucgugcugaagaaggagguguccgagacccagcacgggaccauccucaucaaggucgaguacaagggcgaggacgugccgugcaagauccccuucagcacggaggacggccaggggaaggcccacaacggccggcugaucaccgccaaccccguggucaccaagaaggaggagcccgugaacaucgaggcggagccgcccuucggggaguccaacaucgugaucggcaucggggacaacgcccugaagaucaacugguacaagaagggcagcuccaucggcaagauguucgaggccaccgcccgcggggcccggcgcauggcgauccucggcgacacggccugggacuucgggagcgucggcggggugcugaacucccugggcaagauggugcaccagaucuucggcagcgccuacaccgcccucuucuccggggucagcugggugaugaagaucggcaucggggugcugcugaccuggaucggccucaacuccaagaacaccagcauguccuucagcugcaucgccaucgggaucaucacgcuguaccugggcgcggucgugcaggcc

SEQ ID NO: 1518 - RNA, 45 nt, Artificial Sequence; identical to SEQ ID NO: 1362
  derived and/or modified CDS sequence (opt1) from DENV-3 Consensus__SSc

SEQ ID NO: 1519 - RNA, 57 nt, Artificial Sequence; identical to SEQ ID NO: 1363
  derived and/or modified CDS sequence (opt1) from DENV-3 Consensus__SSopt

SEQ ID NO: 1520 - RNA, 57 nt, Artificial Sequence
  derived and/or modified CDS sequence (opt1) from DENV-3 Consensus__SSm
augacccagaagguggucaucuucauccugcucaugcuggugacccccagcaugacg

SEQ ID NO: 1521 - RNA, 1482 nt, Artificial Sequence
  derived and/or modified CDS sequence (opt1) from DENV-3 Consensus__E
augcgcugcgugggcgucgggaaccgggacuucguggagggccugagcggggccaccuggguggacgucgugcucgagcacggcgggugcgugaccacgauggccaagaacaagcccacccuggacaucgagcugcagaagaccgaggcgacccagcucgccacgcugcgcaagcugugcaucgagggcaagaucaccaacaucaccaccgacucccggugccccacgcagggcgaggccacccuccccgaggagcaggaccagaacuacgucugcaagcacaccuacguggaccgcggguggggcaacgggugcggccuguucgggaagggcagccuggugaccugcgccaaguuccagugccucgagcccaucgagggcaaggucgugcaguacgagaaccugaaguacacggugaucaucaccguccacaccggggaccagcaccaggugggcaacgagacccagggggugacggccgagaucacgccccaggcguccaccaccgaggccauccugccggaguacggcacccucggccuggagugcagcccccggaccgggcuggacuucaacgagaugauccuccugaccaugaagaacaaggccuggaugguccaccgccagugguucuucgaccugccccuccccuggaccuccggcgccacgaccgagaccccgaccuggaaccggaaggagcugcuggugacguucaagaacgcgcacgccaagaagcaggagguggucgugcucgggagccaggagggcgccaugcacaccgcccugaccggggccaccgagauccagaacuccggcggcacgagcaucuucgcggggcaccugaagugccgccucaagauggacaagcuggagcugaagggcauguccuacgccaugugcaccaacaccuucgugcucaagaaggaggucagcgagacccagcacgggacgauccugaucaagguggaguacaagggcgaggacgugcccugcaagauccccuucuccaccgaggacgggcagggcaaggcccacaacggccggcugaucaccgccaaccccgucgugaccaagaaggaggagccggucaacaucgaggccgagccgcccuucggggagagcaacaucgugaucggcaucggggacaacgcgcucaagaucaacugguacaagaagggcuccagcaucgggaagauguucgaggccaccgcccgcggcgcccggcgcauggccauccugggcgacacggcgugggacuucggguccgugggcgggguccugaacagccucggcaagauggugcaccagaucuucggcuccgccuacaccgcccuguucagcgggguguccugggucaugaagaucggcaucggggugcugcucaccuggaucggccugaacagcaagaacaccagcauguccuucagcugcaucgccaucgggaucaucacgcuguaccucggcgccgugguccaggcguga

SEQ ID NO: 1522 - RNA, 1176 nt, Artificial Sequence
  derived and/or modified CDS sequence (opt1) from DENV-3 Consensus__EdelTM-variant (aa1-392)
augcgcugcgugggcgucgggaaccgggacuucguggagggccugagcggggccaccuggguggacgucgugcucgagcacggcgggugcgugaccacgauggccaagaacaagcccacccuggacaucgagcugcagaagaccgaggcgacccagcucgccacgcugcgcaagcugugcaucgagggcaagaucaccaacaucaccaccgacucccggugccccacgcagggcgaggccacccuccccgaggagcaggaccagaacuacgucugcaagcacaccuacguggaccgcggguggggcaacgggugcggccuguucgggaagggcagccuggugaccugcgccaaguuccagugccucgagcccaucgagggcaaggucgugcaguacgagaaccugaaguacacggugaucaucaccguccacaccggggaccagcaccaggugggcaacgagacccagggggugacggccgagaucacgccccaggcguccaccaccgaggccauccugccggaguacggcacccucggccuggagugcagcccccggaccgggcuggacuucaacgagaugauccuccugaccaugaagaacaaggccuggaugguccaccgccagugguucuucgaccugccccuccccuggaccuccggcgccacgaccgagaccccgaccuggaaccggaaggagcugcuggugacguucaagaacgcgcacgccaagaagcaggagguggucgugcucgggagccaggagggcgccaugcacaccgcccugaccggggccaccgagauccagaacuccggcggcacgagcaucuucgcggggcaccugaagugccgccucaagauggacaagcuggagcugaagggcauguccuacgccaugugcaccaacaccuucgugcucaagaaggaggucagcgagacccagcacgggacgauccugaucaagguggaguacaagggcgaggacgugcccugcaagauccccuucuccaccgaggacgggcagggcaaggcccacaacggccggcugaucaccgccaaccccgucgugaccaagaaggaggagccggucaacaucgaggccgagccgcccuucggggagagcaacaucgugaucggcaucggggacaacgcgcucaagaucaacugguacaagaag

SEQ ID NO: 1523 - RNA, 1269 nt, Artificial Sequence
  derived and/or modified CDS sequence (opt1) from DENV-3 Consensus__EdelTM-variant (aa1-422)
augcgcugcgugggcgucgggaaccgggacuucguggagggccugagcggggccaccuggguggacgucgugcucgagcacggcgggugcgugaccacgauggccaagaacaagcccacccuggacaucgagcugcagaagaccgaggcgacccagcucgccacgcugcgcaagcugugcaucgagggcaagaucaccaacaucaccaccgacucccggugccccacgcagggcgaggccacccuccccgaggagcaggaccagaacuacgucugcaagcacaccuacguggaccgcggguggggcaacgggugcggccuguucgggaagggcagccuggugaccugcgccaaguuccagugccucgagcccaucgagggcaaggucgugcaguacgagaaccugaaguacacggugaucaucaccguccacaccggggaccagcaccaggugggcaacgagacccagggggugacggccgagaucacgccccaggcguccaccaccgaggccauccugccggaguacggcacccucggccuggagugcagcccccggaccgggcuggacuucaacgagaugauccuccugaccaugaagaacaaggccuggaugguccaccgccagugguucuucgaccugccccuccccuggaccuccggcgccacgaccgagaccccgaccuggaaccggaaggagcugcuggugacguucaagaacgcgcacgccaagaagcaggagguggucgugcucgggagccaggagggcgccaugcacaccgcccugaccggggccaccgagauccagaacuccggcggcacgagcaucuucgcggggcaccugaagugccgccucaagauggacaagcuggagcugaagggcauguccuacgccaugugcaccaacaccuucgugcucaagaaggaggucagcgagacccagcacgggacgauccugaucaagguggaguacaagggcgaggacgugcccugcaagauccccuucuccaccgaggacgggcagggcaaggcccacaacggccggcugaucaccgccaaccccgucgugaccaagaaggaggagccggucaacaucgaggccgagccgcccuucggggagagcaacaucgugaucggcaucggggacaacgcgcucaagaucaacugguacaagaagggcuccagcaucgggaagauguucgaggccaccgcccgcggcgcccggcgcauggccauccugggcgacacggcgugggacuucggguccuga

SEQ ID NO: 1524 - RNA, 1260 nt, Artificial Sequence
  derived and/or modified CDS sequence (opt1) from DENV-3 Consensus__EdelTM-variant (aa1-419)
augcgcugcgugggcgucgggaaccgggacuucguggagggccugagcggggccaccuggguggacgucgugcucgagcacggcgggugcgugaccacgauggccaagaacaagcccacccuggacaucgagcugcagaagaccgaggcgacccagcucgccacgcugcgcaagcugugcaucgagggcaagaucaccaacaucaccaccgacucccggugccccacgcagggcgaggccacccuccccgaggagcaggaccagaacuacgucugcaagcacaccuacguggaccgcggguggggcaacgggugcggccuguucgggaagggcagccuggugaccugcgccaaguuccagugccucgagcccaucgagggcaaggucgugcaguacgagaaccugaaguacacggugaucaucaccguccacaccggggaccagcaccaggugggcaacgagacccagggggugacggccgagaucacgccccaggcguccaccaccgaggccauccugccggaguacggcacccucggccuggagugcagcccccggaccgggcuggacuucaacgagaugauccuccugaccaugaagaacaaggccuggaugguccaccgccagugguucuucgaccugccccuccccuggaccuccggcgccacgaccgagaccccgaccuggaaccggaaggagcugcuggugacguucaagaacgcgcacgccaagaagcaggagguggucgugcucgggagccaggagggcgccaugcacaccgcccugaccggggccaccgagauccagaacuccggcggcacgagcaucuucgcggggcaccugaagugccgccucaagauggacaagcuggagcugaagggcauguccuacgccaugugcaccaacaccuucgugcucaagaaggaggucagcgagacccagcacgggacgauccugaucaagguggaguacaagggcgaggacgugcccugcaagauccccuucuccaccgaggacgggcagggcaaggcccacaacggccggcugaucaccgccaaccccgucgugaccaagaaggaggagccggucaacaucgaggccgagccgcccuucggggagagcaacaucgugaucggcaucggggacaacgcgcucaagaucaacugguacaagaagggcuccagcaucgggaagauguucgaggccaccgcccgcggcgcccggcgcauggccauccugggcgacacggcgugggacuga

SEQ ID NO: 1525 - RNA, 1155 nt, Artificial Sequence
  derived and/or modified CDS sequence (opt1) from DENV-3 Consensus__Edelaa101-107
augcgcugcgugggcgucgggaaccgggacuucguggagggccugagcggggccaccuggguggacgucgugcucgagcacggcgggugcgugaccacgauggccaagaacaagcccacccuggacaucgagcugcagaagaccgaggcgacccagcucgccacgcugcgcaagcugugcaucgagggcaagaucaccaacaucaccaccgacucccggugccccacgcagggcgaggccacccuccccgaggagcaggaccagaacuacgucugcaagcacaccuacguggaccgcggguucggcaaggggagccuggugaccugcgccaaguuccagugccuggagcccaucgagggcaaggucgugcaguacgagaaccucaaguacacggugaucaucaccguccacaccggggaccagcaccaggugggcaacgagacccagggcgugacggccgagaucacgccccaggcguccaccaccgaggccauccugccggaguacgggacccugggccucgagugcagcccccggaccgggcuggacuucaacgagaugauccugcucaccaugaagaacaaggccuggaugguccaccgccagugguucuucgaccugccccugcccuggaccuccggcgccacgaccgagaccccgaccuggaaccggaaggagcuccuggugacguucaagaacgcgcacgccaagaagcaggagguggucgugcugggcagccaggagggggccaugcacaccgcccucaccggcgccaccgagauccagaacuccgggggcacgagcaucuucgcggggcaccugaagugccgccugaagauggacaagcucgagcugaagggcauguccuacgccaugugcaccaacaccuucgugcugaagaaggaggucagcgagacccagcacggcacgauccucaucaagguggaguacaagggggaggacgugcccugcaagauccccuucuccaccgaggacggccaggggaaggcccacaacggccggcugaucaccgccaaccccgucgugaccaagaaggaggagccggucaacaucgaggccgagccgcccuucggggagagcaacaucgugaucggcaucggcgacaacgcgcugaagaucaacugguacaagaag

SEQ ID NO: 1526 - RNA, 1173 nt, Artificial Sequence
  derived and/or modified CDS sequence (opt1) from DENV-3 Consensus__EdelTM-variant (aa1-391)
augcgcugcgugggcgucgggaaccgggacuucguggagggccugagcggggccaccuggguggacgucgugcucgagcacggcgggugcgugaccacgauggccaagaacaagcccacccuggacaucgagcugcagaagaccgaggcgacccagcucgccacgcugcgcaagcugugcaucgagggcaagaucaccaacaucaccaccgacucccggugccccacgcagggcgaggccacccuccccgaggagcaggaccagaacuacgucugcaagcacaccuacguggaccgcggguggggcaacgggugcggccuguucgggaagggcagccuggugaccugcgccaaguuccagugccucgagcccaucgagggcaaggucgugcaguacgagaaccugaaguacacggugaucaucaccguccacaccggggaccagcaccaggugggcaacgagacccagggggugacggccgagaucacgccccaggcguccaccaccgaggccauccugccggaguacggcacccucggccuggagugcagcccccggaccgggcuggacuucaacgagaugauccuccugaccaugaagaacaaggccuggaugguccaccgccagugguucuucgaccugccccuccccuggaccuccggcgccacgaccgagaccccgaccuggaaccggaaggagcugcuggugacguucaagaacgcgcacgccaagaagcaggagguggucgugcucgggagccaggagggcgccaugcacaccgcccugaccggggccaccgagauccagaacuccggcggcacgagcaucuucgcggggcaccugaagugccgccucaagauggacaagcuggagcugaagggcauguccuacgccaugugcaccaacaccuucgugcucaagaaggaggucagcgagacccagcacgggacgauccugaucaagguggaguacaagggcgaggacgugcccugcaagauccccuucuccaccgaggacgggcagggcaaggcccacaacggccggcugaucaccgccaaccccgucgugaccaagaaggaggagccggucaacaucgaggccgagccgcccuucggggagagcaacaucgugaucggcaucggggacaacgcgcucaagaucaacugguacaag

SEQ ID NO: 1527 - RNA, 2025 nt, Artificial Sequence
  derived and/or modified CDS sequence (opt1) from DENV-3 Consensus__SSc-prME
augaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcaccggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccuga

SEQ ID NO: 1528 - RNA, 2025 nt, Artificial Sequence
  derived and/or modified CDS sequence (opt1) from DENV-3 Consensus__SSc-prME(F108S)
augaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuccgggaagggcagccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccuccaccaccgaggcgauccugcccgaguacggcacccuggggcucgagugcagcccgcgcaccggccuggacuucaacgagaugauccugcucaccaugaagaacaaggccuggaugguccaccggcagugguucuucgaccugccccugcccuggaccuccggcgccaccacggagacccccaccuggaaccgcaaggagcuccuggugaccuucaagaacgcccacgccaagaagcaggagguggucgugcuggggagccaggagggcgcgaugcacacggcccucaccggggccaccgagauccagaacuccggcgggaccagcaucuucgccggccaccugaagugccggcugaagauggacaagcucgagcugaagggcauguccuacgccaugugcacgaacaccuucgugcugaagaaggaggucagcgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggaguccaacaucgucaucggcaucggggacaacgcccugaagaucaacugguacaagaagggcagcuccaucgggaagauguucgaggcgaccgcccggggcgcccgccggauggccauccugggcgacacggccugggacuucgggagcgugggcggggugcucaacucccugggcaagaugguccaccagaucuucgggagcgcguacaccgcccuguucuccggcgugagcugggugaugaagaucggcaucgggguccuccugaccuggaucggccugaacuccaagaacaccagcauguccuucagcugcaucgccaucgggaucaucacgcucuaccugggcgccguggugcaggccuga

SEQ ID NO: 1529 - RNA, 2025 nt, Artificial Sequence
  derived and/or modified CDS sequence (opt1) from DENV-3 Consensus__SSc-prME(R186L)
augaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcugaccggccuggacuucaacgagaugauccuccugaccaugaagaacaaggccuggaugguccaccgccagugguucuucgaccugccccuccccuggaccagcggcgccaccacggagacccccaccuggaaccggaaggagcugcuggugaccuucaagaacgcccacgccaagaagcaggagguggucgugcucgggucccaggagggcgcgaugcacacggcccugaccggggccaccgagauccagaacagcggcgggaccuccaucuucgccggccaccugaagugccgccucaagauggacaagcuggagcugaagggcaugagcuacgccaugugcacgaacaccuucgugcucaagaaggaggucuccgagacccagcacgggaccauccugaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccucggcgacacggccugggacuucggguccgugggcggggugcugaacagccugggcaagaugguccaccagaucuucggguccgcguacaccgcccucuucagcggcguguccugggugaugaagaucggcaucgggguccugcugaccuggaucggccucaacagcaagaacaccuccaugagcuucuccugcaucgccaucgggaucaucacgcuguaccugggcgccguggugcaggccuga

SEQ ID NO: 1530 - RNA, 2025 nt, Artificial Sequence
  derived and/or modified CDS sequence (opt1) from DENV-3 Consensus__SSc-prME(A265T)
augaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcaccggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggacguccaucuucgccggccaccugaagugccggcugaagauggacaagcucgagcugaagggcaugagcuacgccaugugcaccaacaccuucgugcugaagaaggaggucuccgagacccagcacgggacgauccucaucaagguggaguacaagggcgaggacgugccgugcaagauccccuucagcaccgaggacgggcagggcaaggcccacaacggccgccugaucaccgcgaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggccacggcgcggggcgcccgccggauggccauccugggcgacaccgccugggacuucggguccgugggcggggugcucaacagccugggcaagaugguccaccagaucuucggguccgccuacaccgcgcuguucagcggcguguccugggugaugaagaucggcaucgggguccuccugaccuggaucggccugaacagcaagaacacguccaugagcuucuccugcaucgccaucgggaucaucacccucuaccugggcgccguggugcaggccuga

SEQ ID NO: 1531 - RNA, 2025 nt, Artificial Sequence
  derived and/or modified CDS sequence (opt1) from DENV-3 Consensus__SSc-prMEdelstem_TM-JEV
augaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcaccggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccacccuggggaaggcguucagcacgacccucaagggcgcccagcggcuggccgcccugggcgacaccgccugggacuucggguccaucggcgggguguucaacagcaucggccgcgcggugcaccaggucuucgggggcgccuuccggacccucuucggcgggauguccuggaucacgcagggccugaugggggcccugcuccuguggaugggcgugaacgcccgcgaccgcagcaucgcccuggcguuccucgccaccgggggcgugcuggucuuccuggccaccaacgugcacgccuga

SEQ ID NO: 1532 - RNA, 1326 nt, Artificial Sequence
  derived and/or modified CDS sequence (opt1) from DENV-3 Consensus__SSm-EdelTM
augacccagaagguggucaucuucauccugcucaugcuggugacccccagcaugacgaugcgcugcgugggcgucgggaaccgggacuucguggagggccuguccggggccaccuggguggacgucgugcucgagcacggcgggugcgugaccaccauggccaagaacaagcccacgcuggacaucgagcugcagaagaccgaggcgacccagcucgccacccugcgcaagcugugcaucgagggcaagaucacgaacaucaccaccgacagccggugccccacccagggcgaggccacgcuccccgaggagcaggaccagaacuacgucugcaagcacaccuacguggaccgcggguggggcaacgggugcggccuguucgggaagggcucccuggugaccugcgccaaguuccagugccucgagcccaucgagggcaaggucgugcaguacgagaaccugaaguacaccgugaucaucacgguccacaccggggaccagcaccaggugggcaacgagacccagggggugaccgccgagaucacgccgcaggcgagcaccaccgaggccauccugcccgaguacggcacccucggccuggagugcagcccccggacggggcuggacuucaacgagaugauccuccugaccaugaagaacaaggccuggaugguccaccgccagugguucuucgaccugccccucccguggaccuccggcgccaccacggagacccccaccuggaaccggaaggagcugcuggugaccuucaagaacgcgcacgccaagaagcaggagguggucgugcucgggucccaggagggcgccaugcacacggcccugaccggggccaccgagauccagaacagcggcggcaccuccaucuucgcggggcaccugaagugccgccucaagauggacaagcuggagcugaagggcaugagcuacgccaugugcacgaacaccuucgugcucaagaaggaggucuccgagacccagcacgggaccauccugaucaagguggaguacaagggcgaggacguccccugcaagauccccuucagcaccgaggacgggcagggcaaggcccacaacggccggcugaucacggccaacccgguggugaccaagaaggaggagcccgucaacaucgaggccgagccgcccuucggggaguccaacaucgugaucggcaucggggacaacgcgcucaagaucaacugguacaagaagggcagcuccaucgggaagauguucgaggccaccgcccgcggcgcccggcgcauggccauccugggcgacaccgcgugggacuucgggagcuga

SEQ ID NO: 1533 - RNA, 2373 nt, Artificial Sequence
  derived and/or modified CDS sequence (opt1) from DENV-3 Consensus__C-P2A-SSc-prME
augaacaaccagcgcaagaagaccggcaagcccagcaucaacaugcugaagcgggugcgcaaccgggucuccaccgggagccagcucgccaagcgcuucuccaagggccugcugaacgggcagggccccaugaagcucgugauggccuucaucgcguuccugcgguuccuggccaucccgcccacggccggggugcucgcccgcuggggcaccuucaagaaguccggcgccaucaagguccugaagggguucaagaaggagaucagcaacaugcugagcaucaucaacaagcggaagaagaacuucgaccuccugaagcuggcgggcgacguggaguccaaccccgggcccaccagccucugccugaugaugauccugcccgccgcccucgccuuccaccugaccucccgcgacggcgagccccggaugaucguggggaagaacgagcgcggcaagagccuccuguucaagacggcguccggcaucaacaugugcacccugaucgccauggaccugggggagaugugcgacgacaccgucaccuacaagugcccccacaucacggagguggagccggaggacaucgacugcuggugcaaccucaccagcaccugggugaccuacggcacgugcaaccaggccggggagcaccggcgcgacaagcgguccgucgcccuggcgccccacgugggcaugggccuggacacccgcacccagaccuggaugagcgccgagggggccuggcgccagguggagaaggucgagacgugggcccuccggcaccccggcuucaccauccuggcccuguuccucgcccacuacaucgggaccucccugacccagaagguggugaucuucauccugcucaugcuggucacgcccagcaugaccaugcggugcgugggcguggggaaccgcgacuucgucgagggccuguccggcgcgaccuggguggacgugguccucgagcacgggggcugcgugaccacgauggccaagaacaagccgacccuggacaucgagcugcagaagaccgaggccacccagcucgccacgcugcggaagcugugcaucgaggggaagaucaccaacaucaccaccgacagccgcugccccacgcagggcgaggccacccuccccgaggagcaggaccagaacuacgugugcaagcacaccuacgucgaccggggguggggcaacggcugcgggcuguucggcaaggggucccuggugaccugcgcgaaguuccagugccucgagcccaucgagggcaaggucgugcaguacgagaaccugaaguacacggugaucaucaccguccacaccggggaccagcaccaggugggcaacgagacccagggcgugaccgccgagaucacgccgcaggccagcaccaccgaggccauccugcccgaguacgggacccucggccuggagugcagcccccgcacggggcuggacuucaacgagaugauccuccugaccaugaagaacaaggccuggaugguccaccgccagugguucuucgaccugccccugccguggaccuccggcgcgaccacggagacccccaccuggaaccggaaggagcuccuggugaccuucaagaacgcccacgccaagaagcaggagguggucgugcugggcagccaggagggggccaugcacacggcgcucaccggcgccaccgagauccagaacuccgggggcaccagcaucuucgccgggcaccugaagugccgccugaagauggacaagcucgagcugaagggcauguccuacgccaugugcacgaacaccuucgugcugaagaaggaggucagcgagacccagcacggcaccauccucaucaagguggaguacaagggggaggacgugcccugcaagauccccuucuccacggaggacggccaggggaaggcccacaacggccggcugaucaccgcgaacccggucgugaccaagaaggaggagcccgugaacaucgaggccgagccgcccuucggggagagcaacaucgucaucggcaucggcgacaacgcccugaagaucaacugguacaagaagggguccagcaucggcaagauguucgaggccaccgcccgcggggcgcggcgcauggccauccucggcgacacggccugggacuucggguccgugggcggcgugcugaacagccuggggaagaugguccaccagaucuucggcuccgccuacaccgcccucuucagcgggguguccugggugaugaagaucggcaucgggguccugcugaccuggaucggccucaacagcaagaacaccuccaugagcuucuccugcaucgcgaucggcaucaucacgcuguaccugggggccguggugcaggccuga

SEQ ID NO: 1534 - RNA, 2037 nt, Artificial Sequence
  derived and/or modified CDS sequence (opt1) from DENV-3 Consensus__SSopt-prME
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccuga

SEQ ID NO: 1535 - RNA, 2037 nt, Artificial Sequence
  derived and/or modified CDS sequence (opt1) from DENV-3 Consensus__SSopt-prME(F108S)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuccgggaagggcagccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccuccaccaccgaggcgauccugcccgaguacggcacccuggggcucgagugcagcccgcggaccggccuggacuucaacgagaugauccugcucaccaugaagaacaaggccuggaugguccaccgccagugguucuucgaccugccccugcccuggaccuccggcgccaccacggagacccccaccuggaaccggaaggagcuccuggugaccuucaagaacgcccacgccaagaagcaggagguggucgugcuggggagccaggagggcgcgaugcacacggcccucaccggggccaccgagauccagaacuccggcgggaccagcaucuucgccggccaccugaagugccgccugaagauggacaagcucgagcugaagggcauguccuacgccaugugcacgaacaccuucgugcugaagaaggaggucagcgagacccagcacgggaccauccucaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggaguccaacaucgucaucggcaucggggacaacgcccugaagaucaacugguacaagaagggcagcuccaucgggaagauguucgaggcgaccgcccgcggcgcccggcgcauggccauccugggcgacacggccugggacuucgggagcgugggcggggugcucaacucccugggcaagaugguccaccagaucuucgggagcgcguacaccgcccuguucuccggcgugagcugggugaugaagaucggcaucgggguccuccugaccuggaucggccugaacuccaagaacaccagcauguccuucagcugcaucgccaucgggaucaucacgcucuaccugggcgccguggugcaggccuga

SEQ ID NO: 1536 - RNA, 2037 nt, Artificial Sequence
  derived and/or modified CDS sequence (opt1) from DENV-3 Consensus__SSopt-prME(H27N)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagaacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccuga

SEQ ID NO: 1537 - RNA, 2037 nt, Artificial Sequence
  derived and/or modified CDS sequence (opt1) from DENV-3 Consensus__SSopt-prME(T76I)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccauccagggcgaggccacgcugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacaccgugaucaucacggugcacaccggggaccagcaccaggucggcaacgagacccagggggugaccgccgagaucacgccccaggccagcaccaccgaggcgauccugcccgaguacggcacccuggggcucgagugcuccccgcggaccggccuggacuucaacgagaugauccugcucacgaugaagaacaaggccuggaugguccaccgccagugguucuucgaccugccccugcccuggaccagcggcgccaccaccgagacgcccaccuggaaccggaaggagcuccuggugaccuucaagaacgcccacgccaagaagcaggagguggucgugcuggggucccaggagggcgcgaugcacaccgcccucacgggggccaccgagauccagaacagcggcgggaccuccaucuucgccggccaccugaagugccgccugaagauggacaagcucgagcugaagggcaugagcuacgccaugugcaccaacacguucgugcugaagaaggaggucuccgagacccagcacgggaccauccucaucaagguggaguacaagggcgaggacgugccgugcaagauccccuucagcaccgaggacgggcagggcaaggcgcacaacggccggcugaucacggccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccugggcgacaccgccugggacuucggguccgugggcggggugcucaacagccugggcaagaugguccaccagaucuucggguccgcguacacggcccuguucagcggcguguccugggugaugaagaucggcaucgggguccuccugaccuggaucggccugaacagcaagaacaccuccaugagcuucuccugcaucgccaucgggaucaucacccucuaccugggcgccguggugcaggccuga

SEQ ID NO: 1538 - RNA, 2037 nt, Artificial Sequence
  derived and/or modified CDS sequence (opt1) from DENV-3 Consensus__SSopt-prME(N89D)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccaggacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccuga

SEQ ID NO: 1539 - RNA, 2037 nt, Artificial Sequence
  derived and/or modified CDS sequence (opt1) from DENV-3 Consensus__SSopt-prME(Y96H)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacacccacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccuga

SEQ ID NO: 1540 - RNA, 2037 nt, Artificial Sequence
  derived and/or modified CDS sequence (opt1) from DENV-3 Consensus__SSopt-prME(K110E)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucggggagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccuga

SEQ ID NO: 1541 - RNA, 2037 nt, Artificial Sequence
  derived and/or modified CDS sequence (opt1) from DENV-3 Consensus__SSopt-prME(H149N)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagaaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccuga

SEQ ID NO: 1542 - RNA, 2037 nt, Artificial Sequence
  derived and/or modified CDS sequence (opt1) from DENV-3 Consensus__SSopt-prME(S184F)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuucccgcggaccggccuggacuucaacgagaugauccugcucaccaugaagaacaaggccuggaugguccaccgccagugguucuucgaccugccccugcccuggaccuccggcgccaccacggagacccccaccuggaaccggaaggagcuccuggugaccuucaagaacgcccacgccaagaagcaggagguggucgugcuggggagccaggagggcgcgaugcacacggcccucaccggggccaccgagauccagaacuccggcgggaccagcaucuucgccggccaccugaagugccgccugaagauggacaagcucgagcugaagggcauguccuacgccaugugcacgaacaccuucgugcugaagaaggaggucagcgagacccagcacgggaccauccucaucaagguggaguacaagggcgaggacgugccgugcaagauccccuucuccacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcagcuccaucgggaagauguucgaggcgaccgcccgcggcgcccggcgcauggccauccugggcgacacggccugggacuucgggagcgugggcggggugcucaacucccugggcaagaugguccaccagaucuucgggagcgcguacaccgcccuguucuccggcgugagcugggugaugaagaucggcaucgggguccuccugaccuggaucggccugaacuccaagaacaccagcauguccuucagcugcaucgccaucgggaucaucacgcucuaccugggcgccguggugcaggccuga

SEQ ID NO: 1543 - RNA, 2037 nt, Artificial Sequence
  derived and/or modified CDS sequence (opt1) from DENV-3 Consensus__SSopt-prME(R186L)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcugaccggccuggacuucaacgagaugauccuccugaccaugaagaacaaggccuggaugguccaccggcagugguucuucgaccugccccuccccuggaccagcggcgccaccacggagacccccaccuggaaccgcaaggagcugcuggugaccuucaagaacgcccacgccaagaagcaggagguggucgugcucgggucccaggagggcgcgaugcacacggcccugaccggggccaccgagauccagaacagcggcgggaccuccaucuucgccggccaccugaagugccggcucaagauggacaagcuggagcugaagggcaugagcuacgccaugugcacgaacaccuucgugcucaagaaggaggucuccgagacccagcacgggaccauccugaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccucggcgacacggccugggacuucggguccgugggcggggugcugaacagccugggcaagaugguccaccagaucuucggguccgcguacaccgcccucuucagcggcguguccugggugaugaagaucggcaucgggguccugcugaccuggaucggccucaacagcaagaacaccuccaugagcuucuccugcaucgccaucgggaucaucacgcuguaccugggcgccguggugcaggccuga

SEQ ID NO: 1544 - RNA, 2037 nt, Artificial Sequence
  derived and/or modified CDS sequence (opt1) from DENV-3 Consensus__SSopt-prME(N240S)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaaguccgcccacgccaagaagcaggagguggucgugcuggggagccaggagggcgcgaugcacacggcccucaccggggccaccgagauccagaacuccggcgggaccagcaucuucgccggccaccugaagugccgccugaagauggacaagcucgagcugaagggcauguccuacgccaugugcacgaacaccuucgugcugaagaaggaggucagcgagacccagcacgggaccauccucaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggaguccaacaucgucaucggcaucggggacaacgcccugaagaucaacugguacaagaagggcagcuccaucgggaagauguucgaggcgaccgcccgcggcgcccggcgcauggccauccugggcgacacggccugggacuucgggagcgugggcggggugcucaacucccugggcaagaugguccaccagaucuucgggagcgcguacaccgcccuguucuccggcgugagcugggugaugaagaucggcaucgggguccuccugaccuggaucggccugaacuccaagaacaccagcauguccuucagcugcaucgccaucgggaucaucacgcucuaccugggcgccguggugcaggccuga

SEQ ID NO: 1545 - RNA, 2037 nt, Artificial Sequence
  derived and/or modified CDS sequence (opt1) from DENV-3 Consensus__SSopt-prME(M258L)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgcuccacacggcccugaccggggccaccgagauccagaacagcggcgggaccuccaucuucgccggccaccugaagugccgccucaagauggacaagcuggagcugaagggcaugagcuacgccaugugcacgaacaccuucgugcucaagaaggaggucuccgagacccagcacgggaccauccugaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccucggcgacacggccugggacuucggguccgugggcggggugcugaacagccugggcaagaugguccaccagaucuucggguccgcguacaccgcccucuucagcggcguguccugggugaugaagaucggcaucgggguccugcugaccuggaucggccucaacagcaagaacaccuccaugagcuucuccugcaucgccaucgggaucaucacgcuguaccugggcgccguggugcaggccuga

SEQ ID NO: 1546 - RNA, 2037 nt, Artificial Sequence
  derived and/or modified CDS sequence (opt1) from DENV-3 Consensus__SSopt-prME(H259N)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugaacacggcccucaccggggccaccgagauccagaacagcggcgggaccuccaucuucgccggccaccugaagugccgccugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccgcggcgcccggcgcauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccuga

SEQ ID NO: 1547 - RNA, 2037 nt, Artificial Sequence
  derived and/or modified CDS sequence (opt1) from DENV-3 Consensus__SSopt-prME(H259R)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugcgcacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccgcauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccuga

SEQ ID NO: 1548 - RNA, 2037 nt, Artificial Sequence
  derived and/or modified CDS sequence (opt1) from DENV-3 Consensus__SSopt-prME(A265T)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugcacacggcccucaccgggaccaccgagauccagaacagcggcgggacguccaucuucgccggccaccugaagugccgccugaagauggacaagcucgagcugaagggcaugagcuacgccaugugcaccaacaccuucgugcugaagaaggaggucuccgagacccagcacgggacgauccucaucaagguggaguacaagggcgaggacgugccgugcaagauccccuucagcaccgaggacgggcagggcaaggcccacaacggccggcugaucaccgcgaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggccacggcgcgcggcgcccggcgcauggccauccugggcgacaccgccugggacuucggguccgugggcggggugcucaacagccugggcaagaugguccaccagaucuucggguccgccuacaccgcgcuguucagcggcguguccugggugaugaagaucggcaucgggguccuccugaccuggaucggccugaacagcaagaacacguccaugagcuucuccugcaucgccaucgggaucaucacccucuaccugggcgccguggugcaggccuga

SEQ ID NO: 1549 - RNA, 2037 nt, Artificial Sequence
  derived and/or modified CDS sequence (opt1) from DENV-3 Consensus__SSopt-prME(S296G)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccgccugaagauggacaagcucgagcugaagggcaugggguacgccaugugcacgaacaccuucgugcugaagaaggaggucagcgagacccagcacggcaccauccucaucaagguggaguacaagggggaggacgugccgugcaagauccccuucuccacggaggacggccagggcaaggcgcacaacgggcggcugaucaccgccaaccccgucgugaccaagaaggaggagcccgugaacaucgaggccgagccgcccuucggcgagagcaacaucgucaucgggaucggcgacaacgcccugaagaucaacugguacaagaaggggagcuccaucggcaagauguucgaggcgaccgcccgcggcgcccggcgcauggccauccugggggacacggccugggacuucggcagcgucgggggcgugcucaacucccuggggaagauggugcaccagaucuucggcagcgcguacaccgcccuguucuccggcgugagcugggugaugaagaucgggaucggcguccuccugaccuggaucgggcugaacuccaagaacaccagcauguccuucagcugcaucgccaucggcaucaucacgcucuaccugggggccguggugcaggccuga

SEQ ID NO: 1550 - RNA, 2037 nt, Artificial Sequence
  derived and/or modified CDS sequence (opt1) from DENV-3 Consensus__SSopt-prME(S311R)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcacgaacaccuucgugcugaagaaggagguccgggagacccagcacgggaccauccucaucaagguggaguacaagggcgaggacgugccgugcaagauccccuucuccacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcagcuccaucgggaagauguucgaggcgaccgcccggggcgcccgccgcauggccauccugggcgacacggccugggacuucgggagcgugggcggggugcucaacucccugggcaagaugguccaccagaucuucgggagcgcguacaccgcccuguucuccggcgugagcugggugaugaagaucggcaucgggguccuccugaccuggaucggccugaacuccaagaacaccagcauguccuucagcugcaucgccaucgggaucaucacgcucuaccugggcgccguggugcaggccuga

SEQ ID NO: 1551 - RNA, 2037 nt, Artificial Sequence
  derived and/or modified CDS sequence (opt1) from DENV-3 Consensus__SSopt-prME(K321T)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcacgaacaccuucgugcugaagaaggaggucuccgagacccagcacgggaccauccucaucacgguggaguacaagggcgaggacgugccgugcaagauccccuucagcaccgaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgacggcccgcggcgcccggcgcauggccauccugggcgacaccgccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacacguccaugagcuucuccugcaucgccaucgggaucaucacccucuaccugggcgccguggugcaggccuga

SEQ ID NO: 1552 - RNA, 2037 nt, Artificial Sequence
  derived and/or modified CDS sequence (opt1) from DENV-3 Consensus__SSopt-prME(G28C,H242C)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacugcggcugcgugaccacgauggccaagaacaagcccacccucgacaucgagcugcagaagaccgaggccacccagcuggcgacgcuccgcaagcugugcaucgaggggaagaucaccaacaucaccaccgacagccggugccccacgcagggcgaggccacccugccggaggagcaggaccagaacuacgugugcaagcacaccuacgucgaccgcggcugggggaacggcugcggccucuucgggaaggggucccuggugaccugcgccaaguuccagugccuggagcccaucgagggcaaggugguccaguacgagaaccucaaguacacggugaucaucaccgugcacaccggcgaccagcaccaggucgggaacgagacccagggcgugacggccgagaucacgccccaggccagcaccaccgaggcgauccugcccgaguacgggacccugggccucgagugcuccccgcggaccgggcuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgccugcgccaagaagcaggagguggucgugcugggcucccaggagggggcgaugcacacggcccucaccggcgccaccgagauccagaacagcgggggcaccuccaucuucgccgggcaccugaagugccgccugaagauggacaagcucgagcugaagggcaugagcuacgccaugugcacgaacaccuucgugcugaagaaggaggucuccgagacccagcacggcaccauccucaucaagguggaguacaagggggaggacgugccgugcaagauccccuucagcacggaggacggccaggggaaggcgcacaacggccggcugaucaccgccaaccccgucgugaccaagaaggaggagcccgugaacaucgaggccgagccgcccuucggcgagagcaacaucgucaucgggaucggcgacaacgcccugaagaucaacugguacaagaagggguccagcaucggcaagauguucgaggcgaccgcccgcggggcccggcgcauggccauccugggcgacacggccugggacuucggcuccgucgggggcgugcucaacagccuggggaagauggugcaccagaucuucggcuccgcguacaccgcccuguucagcgggguguccugggugaugaagaucggcaucggcguccuccugaccuggaucgggcugaacagcaagaacaccuccaugagcuucuccugcaucgccaucggcaucaucacgcucuaccugggggccguggugcaggccuga

SEQ ID NO: 1553 - RNA, 2037 nt, Artificial Sequence
  derived and/or modified CDS sequence (opt1) from DENV-3 Consensus__SSopt-prME(R186L,A265T)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcugaccggccuggacuucaacgagaugauccuccugaccaugaagaacaaggccuggaugguccaccggcagugguucuucgaccugccccuccccuggaccagcggcgccaccacggagacccccaccuggaaccgcaaggagcugcuggugaccuucaagaacgcccacgccaagaagcaggagguggucgugcucgggucccaggagggcgcgaugcacacggcccugaccgggaccaccgagauccagaacagcggcgggacguccaucuucgccggccaccugaagugccggcucaagauggacaagcuggagcugaagggcaugagcuacgccaugugcaccaacaccuucgugcucaagaaggaggucuccgagacccagcacgggacgauccugaucaagguggaguacaagggcgaggacgugccgugcaagauccccuucagcaccgaggacgggcagggcaaggcccacaacggccgccugaucaccgcgaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggccacggcgcggggcgcccgccggauggccauccucggcgacaccgccugggacuucggguccgugggcggggugcugaacagccugggcaagaugguccaccagaucuucggguccgccuacaccgcccucuucagcggcguguccugggugaugaagaucggcaucgggguccugcugaccuggaucggccucaacagcaagaacacguccaugagcuucuccugcaucgcgaucgggaucaucacccuguaccugggcgccguggugcaggccuga

SEQ ID NO: 1554 - RNA, 2037 nt, Artificial Sequence
  derived and/or modified CDS sequence (opt1) from DENV-3 Consensus__SSopt-pr(D104A)ME(F108S)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggccaagcgcuccgucgcgcucgcgccccacgugggcauggggcuggacacccggacccagaccuggaugagcgccgagggcgccuggcgccagguggagaaggucgagacgugggcccugcggcacccgggguucaccauccucgcccuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggcgacccagcuggccacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuccgggaagggcagccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggcguccaccaccgaggccauccugcccgaguacggcacccuggggcucgagugcagcccgcggaccggccuggacuucaacgagaugauccugcucaccaugaagaacaaggccuggaugguccaccgccagugguucuucgaccugccccugcccuggaccuccggcgccaccacggagacccccaccuggaaccggaaggagcuccuggugaccuucaagaacgcccacgcgaagaagcaggagguggucgugcuggggagccaggagggcgccaugcacacggcccucaccggggccaccgagauccagaacuccggcgggaccagcaucuucgccggccaccugaagugccgccugaagauggacaagcucgagcugaagggcauguccuacgcgaugugcacgaacaccuucgugcugaagaaggaggucagcgagacccagcacgggaccauccucaucaagguggaguacaagggcgaggacgugccgugcaagauccccuucagcacggaggacgggcagggcaaggcccacaacggccggcugaucaccgccaaccccgucgugaccaagaaggaggagcccgugaacaucgaggccgagccgcccuucggggaguccaacaucgucaucggcaucggggacaacgcgcugaagaucaacugguacaagaagggcagcuccaucgggaagauguucgaggccaccgcccgcggcgcccggcgcauggccauccugggcgacacggcgugggacuucgggagcgugggcggggugcucaacucccugggcaagaugguccaccagaucuucgggagcgccuacaccgcccuguucuccggcgugagcugggugaugaagaucggcaucgggguccuccugaccuggaucggccugaacuccaagaacaccagcauguccuucagcugcaucgccaucgggaucaucacgcucuaccugggcgccguggugcaggcguga

SEQ ID NO: 1555 - RNA, 2037 nt, Artificial Sequence
  derived and/or modified CDS sequence (opt1) from DENV-3 Consensus__SSopt-pr(D104A)ME(R186L,A265T)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggccaagcgcuccgucgcgcucgcgccccacgugggcauggggcuggacacccggacccagaccuggaugagcgccgagggcgccuggcgccagguggagaaggucgagacgugggcccugcggcacccgggguucaccauccucgcccuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggcgacccagcuggccacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggcgagcaccaccgaggccauccugcccgaguacggcacccuggggcucgagugcuccccgcugaccggccuggacuucaacgagaugauccuccugaccaugaagaacaaggccuggaugguccaccggcagugguucuucgaccugccccuccccuggaccagcggcgccaccacggagacccccaccuggaaccgcaaggagcugcuggugaccuucaagaacgcccacgcgaagaagcaggagguggucgugcucgggucccaggagggcgccaugcacacggcccugaccgggaccaccgagauccagaacagcggcgggacguccaucuucgccggccaccugaagugccggcucaagauggacaagcuggagcugaagggcaugagcuacgccaugugcaccaacaccuucgugcucaagaaggaggucuccgagacccagcacgggacgauccugaucaagguggaguacaagggcgaggacgugccgugcaagauccccuucagcaccgaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgacggcccggggcgcccgccggauggccauccucggcgacaccgccugggacuucggguccgugggcggggugcugaacagccugggcaagaugguccaccagaucuucggguccgcguacaccgcccucuucagcggcguguccugggugaugaagaucggcaucgggguccugcugaccuggaucggccucaacagcaagaacacguccaugagcuucuccugcaucgccaucgggaucaucacccuguaccugggcgccguggugcaggccuga

SEQ ID NO: 1556 - RNA, 2037 nt, Artificial Sequence
  derived and/or modified CDS sequence (opt1) from DENV-3 Consensus__SSopt-pr(D104A)ME(F108S,R186L,A265T)
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggccaagcgcuccgucgcgcucgcgccccacgugggcauggggcuggacacccggacccagaccuggaugagcgccgagggcgccuggcgccagguggagaaggucgagacgugggcccugcggcacccgggguucaccauccucgcccuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggcgacccagcuggccacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuccgggaagggcagccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggcguccaccaccgaggccauccugcccgaguacggcacccuggggcucgagugcagcccgcugaccggccuggacuucaacgagaugauccuccugaccaugaagaacaaggccuggaugguccaccggcagugguucuucgaccugccccuccccuggaccuccggcgccaccacggagacccccaccuggaaccgcaaggagcugcuggugaccuucaagaacgcccacgcgaagaagcaggagguggucgugcucgggagccaggagggcgccaugcacacggcccugaccgggaccaccgagauccagaacuccggcgggacgagcaucuucgccggccaccugaagugccggcucaagauggacaagcuggagcugaagggcauguccuacgccaugugcaccaacaccuucgugcucaagaaggaggucagcgagacccagcacgggacgauccugaucaagguggaguacaagggcgaggacgugccgugcaagauccccuucagcaccgaggacgggcagggcaaggcgcacaacggccgccugaucaccgccaaccccgucgugaccaagaaggaggagcccgugaacaucgaggccgagccgcccuucggggaguccaacaucgucaucggcaucggggacaacgcccugaagaucaacugguacaagaagggcagcuccaucgggaagauguucgaggcgacggcccggggcgcccgccggauggccauccucggcgacaccgccugggacuucgggagcgugggcggggugcugaacucccugggcaagaugguccaccagaucuucgggagcgcguacaccgcccucuucuccggcgugagcugggugaugaagaucggcaucgggguccugcugaccuggaucggccucaacuccaagaacacgagcauguccuucagcugcaucgccaucgggaucaucacccuguaccugggcgccguggugcaggccuga

SEQ ID NO: 1557 - RNA, 2016 nt, Artificial Sequence
  derived and/or modified CDS sequence (opt1) from DENV-3 Consensus__SSopt-prMEdel101-107,(R99P,F108N)
augaagcgcaagaagaccagccugugccucaugaugauccugcccgccgcccuggcguuccaccucaccucccgggacggcgagccccgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccccgggaacggcaaggggucccucgugaccugcgccaaguuccagugccuggagcccaucgagggcaaggugguccaguacgagaaccugaaguacacggugaucaucaccgugcacaccggggaccagcaccaggucggcaacgagacccagggcgugacggccgagaucacgccccaggccagcaccaccgaggcgauccucccggaguacgggacccugggccuggagugcagcccccgcaccgggcucgacuucaacgagaugauccugcugaccaugaagaacaaggccuggaugguccaccggcagugguucuucgaccucccccugcccuggaccuccggcgccaccacggagaccccgaccuggaaccgcaaggagcugcucgugaccuucaagaacgcccacgccaagaagcaggagguggucgugcuggggucccaggagggcgcgaugcacacggcccugaccggcgccaccgagauccagaacagcgggggcaccuccaucuucgccgggcaccucaagugccggcugaagauggacaagcuggagcucaagggcaugagcuacgccaugugcacgaacaccuucgugcugaagaaggaggucuccgagacccagcacgggaccauccugaucaagguggaguacaagggcgaggacgugcccugcaagauccccuucagcacggaggacggccaggggaaggcgcacaacggccgccucaucaccgccaaccccgucgugaccaagaaggaggagccggugaacaucgaggccgagccgcccuucggggagagcaacaucgucaucggcaucggcgacaacgcccugaagaucaacugguacaagaagggguccagcaucggcaagauguucgaggcgaccgcccgcggggcccggcggauggccauccugggcgacacggccugggacuucggguccgugggcggcgugcugaacagccucgggaagaugguccaccagaucuucggcuccgcguacaccgcccuguucagcgggguguccugggugaugaagaucggcaucgggguccugcucaccuggaucggccugaacagcaagaacaccuccaugagcuucuccugcaucgccaucggcaucaucacgcuguaccucggggccguggugcaggccuga

SEQ ID NO: 1558 - RNA, 2037 nt, Artificial Sequence
  derived and/or modified CDS sequence (opt1) from DENV-3 Consensus__SSopt-prMEdelstem_TM-JEV
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccgccugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccacccuggggaaggcguucagcacgacccucaagggcgcccagcgccuggccgcccugggcgacaccgccugggacuucggguccaucggcgggguguucaacagcaucggccgggcggugcaccaggucuucgggggcgccuuccgcacccucuucggcgggauguccuggaucacgcagggccugaugggggcccugcuccuguggaugggcgugaacgcccgcgaccggagcaucgcccuggcguuccucgccaccgggggcgugcuggucuuccuggccaccaacgugcacgccuga

SEQ ID NO: 1559 - RNA, 2037 nt, Artificial Sequence
  derived and/or modified CDS sequence (opt1) from DENV-3 Consensus__SSopt-pr(D104A)MEdelstem_TM,(F108S)-JEV
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggccaagcgcuccgucgcgcucgcgccccacgugggcauggggcuggacacccggacccagaccuggaugagcgccgagggcgccuggcgccagguggagaaggucgagacgugggcccugcggcacccgggguucaccauccucgcccuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggcgacccagcuggccacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuccgggaagggcagccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggcguccaccaccgaggccauccugcccgaguacggcacccuggggcucgagugcagcccgcggaccggccuggacuucaacgagaugauccugcucaccaugaagaacaaggccuggaugguccaccgccagugguucuucgaccugccccugcccuggaccuccggcgccaccacggagacccccaccuggaaccggaaggagcuccuggugaccuucaagaacgcccacgcgaagaagcaggagguggucgugcuggggagccaggagggcgccaugcacacggcccucaccggggccaccgagauccagaacuccggcgggaccagcaucuucgccggccaccugaagugccgccugaagauggacaagcucgagcugaagggcauguccuacgcgaugugcacgaacaccuucgugcugaagaaggaggucagcgagacccagcacgggaccauccucaucaagguggaguacaagggcgaggacgugccgugcaagauccccuucagcacggaggacgggcagggcaaggcccacaacggccggcugaucaccgccaaccccgucgugaccaagaaggaggagcccgugaacaucgaggccgagccgcccuucggggaguccaacaucgucaucggcaucggggacaacgcgcugaagaucaacugguacaagaagggcagcacccuggggaaggccuucuccacgacccucaagggcgcccagcgccuggccgcccugggcgacaccgcgugggacuucgggagcaucggcgggguguucaacuccaucggccgggccgugcaccaggucuucgggggcgccuuccgcacccucuucggcgggaugagcuggaucacgcagggccugaugggggcccugcuccuguggaugggcgugaacgcccgcgaccgguccaucgcgcuggccuuccucgccaccgggggcgugcuggucuuccuggccaccaacgugcacgccuga

SEQ ID NO: 1560 - RNA, 2037 nt, Artificial Sequence
  derived and/or modified CDS sequence (opt1) from DENV-3 Consensus__SSopt-pr(D104A)MEdelstem_TM,(R186L,A265T)-JEV
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggccaagcgcuccgucgcgcucgcgccccacgugggcauggggcuggacacccggacccagaccuggaugagcgccgagggcgccuggcgccagguggagaaggucgagacgugggcccugcggcacccgggguucaccauccucgcccuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggcgacccagcuggccacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggcgagcaccaccgaggccauccugcccgaguacggcacccuggggcucgagugcuccccgcugaccggccuggacuucaacgagaugauccuccugaccaugaagaacaaggccuggaugguccaccggcagugguucuucgaccugccccuccccuggaccagcggcgccaccacggagacccccaccuggaaccgcaaggagcugcuggugaccuucaagaacgcccacgcgaagaagcaggagguggucgugcucgggucccaggagggcgccaugcacacggcccugaccgggaccaccgagauccagaacagcggcgggacguccaucuucgccggccaccugaagugccggcucaagauggacaagcuggagcugaagggcaugagcuacgccaugugcaccaacaccuucgugcucaagaaggaggucuccgagacccagcacgggacgauccugaucaagguggaguacaagggcgaggacgugccgugcaagauccccuucagcaccgaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccacgcucgggaaggcguucagcaccacccugaagggcgcccagcggcuggccgcccucggcgacaccgccugggacuucggguccaucggcgggguguucaacagcaucggccgcgcggugcaccaggucuucgggggcgccuuccggacgcuguucggcgggauguccuggaucacccagggccugaugggggcccuccugcuguggaugggcgugaacgcccgcgaccgcagcaucgcccucgcguuccuggccaccgggggcgugcuggucuuccucgccaccaacgugcacgccuga

SEQ ID NO: 1561 - RNA, 2037 nt, Artificial Sequence
  derived and/or modified CDS sequence (opt1) from DENV-3 Consensus__SSopt-pr(D104A)MEdelstem_TM,(F108S,R186L,A265T)-JEV
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggccaagcgcuccgucgcgcucgcgccccacgugggcauggggcuggacacccggacccagaccuggaugagcgccgagggcgccuggcgccagguggagaaggucgagacgugggcccugcggcacccgggguucaccauccucgcccuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggcgacccagcuggccacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuccgggaagggcagccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggcguccaccaccgaggccauccugcccgaguacggcacccuggggcucgagugcagcccgcugaccggccuggacuucaacgagaugauccuccugaccaugaagaacaaggccuggaugguccaccggcagugguucuucgaccugccccuccccuggaccuccggcgccaccacggagacccccaccuggaaccgcaaggagcugcuggugaccuucaagaacgcccacgcgaagaagcaggagguggucgugcucgggagccaggagggcgccaugcacacggcccugaccgggaccaccgagauccagaacuccggcgggacgagcaucuucgccggccaccugaagugccggcucaagauggacaagcuggagcugaagggcauguccuacgccaugugcaccaacaccuucgugcucaagaaggaggucagcgagacccagcacgggacgauccugaucaagguggaguacaagggcgaggacgugccgugcaagauccccuucagcaccgaggacgggcagggcaaggcgcacaacggccgccugaucaccgccaaccccgucgugaccaagaaggaggagcccgugaacaucgaggccgagccgcccuucggggaguccaacaucgucaucggcaucggggacaacgcccugaagaucaacugguacaagaagggcagcacgcucgggaaggcguucuccaccacccugaagggcgcccagcggcuggccgcccucggcgacaccgccugggacuucgggagcaucggcgggguguucaacuccaucggccgcgcggugcaccaggucuucgggggcgccuuccggacgcuguucggcgggaugagcuggaucacccagggccugaugggggcccuccugcuguggaugggcgugaacgcccgcgaccgcuccaucgcccucgcguuccuggccaccgggggcgugcuggucuuccucgccaccaacgugcacgccuga

SEQ ID NO: 1562 - RNA, 2037 nt, Artificial Sequence
  derived and/or modified CDS sequence (opt1) from DENV-3 Consensus__SSopt-prMEdelstem_TM,(H259N)-JEV
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcggaccggccuggacuucaacgagaugauccugcucaccaugaagaacaaggccuggaugguccaccgccagugguucuucgaccugccccugcccuggaccagcggcgccaccacggagacccccaccuggaaccggaaggagcuccuggugaccuucaagaacgcccacgccaagaagcaggagguggucgugcuggggucccaggagggcgcgaugaacacggcccucaccggggccaccgagauccagaacagcggcgggaccuccaucuucgccggccaccugaagugccgccugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccggcugaucaccgccaaccccgucgugaccaagaaggaggagcccgugaacaucgaggccgagccgcccuucggggagagcaacaucgucaucggcaucggggacaacgcccugaagaucaacugguacaagaagggcuccacccuggggaaggcguucagcacgacccucaagggcgcccagcgccuggccgcccugggcgacaccgccugggacuucggguccaucggcgggguguucaacagcaucggccgggcggugcaccaggucuucgggggcgccuuccgcacccucuucggcgggauguccuggaucacgcagggccugaugggggcccugcuccuguggaugggcgugaacgcccgcgaccggagcaucgcccuggcguuccucgccaccgggggcgugcuggucuuccuggccaccaacgugcacgccuga

SEQ ID NO: 1563 - RNA, 2037 nt, Artificial Sequence
  derived and/or modified CDS sequence (opt1) from DENV-3 Consensus__SSopt-prMEdelstem_TM,(R186L,A265T)-JEV
augaagcgcaagaagaccagccugugccucaugaugauccugcccgccgcccuggcguuccaccucaccucccgggacggcgagccgcgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccgcggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcugaccggccuggacuucaacgagaugauccuccugaccaugaagaacaaggccuggaugguccaccggcagugguucuucgaccugccccuccccuggaccagcggcgccaccacggagacccccaccuggaaccgcaaggagcugcuggugaccuucaagaacgcccacgccaagaagcaggagguggucgugcucgggucccaggagggcgcgaugcacacggcccugaccgggaccaccgagauccagaacagcggcgggacguccaucuucgccggccaccugaagugccggcucaagauggacaagcuggagcugaagggcaugagcuacgccaugugcaccaacaccuucgugcucaagaaggaggucuccgagacccagcacgggacgauccugaucaagguggaguacaagggcgaggacgugccgugcaagauccccuucagcaccgaggacgggcagggcaaggcccacaacggccgccugaucaccgcgaaccccgucgugaccaagaaggaggagcccgugaacaucgaggccgagccgcccuucggggagagcaacaucgucaucggcaucggggacaacgcccugaagaucaacugguacaagaagggcuccacgcucgggaaggccuucagcaccacccugaagggcgcgcagcggcuggccgcccucggcgacaccgccugggacuucggguccaucggcgggguguucaacagcaucggccgcgccgugcaccaggucuucgggggcgcguuccggacgcuguucggcgggauguccuggaucacccagggccugaugggggcccuccugcuguggaugggcgugaacgcccgcgaccgcagcaucgcccucgccuuccuggcgaccgggggcgugcuggucuuccucgccaccaacgugcacgccuga

SEQ ID NO: 1564 - RNA, 2016 nt, Artificial Sequence
  derived and/or modified CDS sequence (opt1) from DENV-3 Consensus__SSopt-prMEdelstem_TM,del101-107,(R99P,F108N)-JEV
augaagcgcaagaagaccagccugugccucaugaugauccugcccgccgcccuggcguuccaccucaccucccgggacggcgagccccgcaugaucguggggaagaacgagcggggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccgccgggacaagcgcuccgucgcccucgcgccccacgugggcauggggcuggacacccggacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcgcugcgugggggugggcaaccgggacuucgucgagggccuguccggggccaccuggguggacgugguccuggagcacggcgggugcgugaccacgauggccaagaacaagcccacccucgacaucgagcugcagaagaccgaggccacccagcuggcgacgcuccgcaagcugugcaucgagggcaagaucaccaacaucaccaccgacagccggugccccacgcagggcgaggccacccugccggaggagcaggaccagaacuacgugugcaagcacaccuacgucgaccccgggaacggcaaggggucccucgugaccugcgccaaguuccagugccuggagcccaucgagggcaaggugguccaguacgagaaccugaaguacacggugaucaucaccgugcacaccggggaccagcaccaggucggcaacgagacccagggcgugacggccgagaucacgccccaggccagcaccaccgaggcgauccucccggaguacgggacccugggccuggagugcagcccccgcaccgggcucgacuucaacgagaugauccugcugaccaugaagaacaaggccuggaugguccaccggcagugguucuucgaccucccccugcccuggaccuccggcgccaccacggagaccccgaccuggaaccgcaaggagcugcucgugaccuucaagaacgcccacgccaagaagcaggagguggucgugcuggggucccaggagggcgcgaugcacacggcccugaccggcgccaccgagauccagaacagcgggggcaccuccaucuucgccgggcaccucaagugccggcugaagauggacaagcuggagcucaagggcaugagcuacgccaugugcacgaacaccuucgugcugaagaaggaggucuccgagacccagcacgggaccauccugaucaagguggaguacaagggcgaggacgugcccugcaagauccccuucagcacggaggacggccaggggaaggcgcacaacggccgccucaucaccgccaaccccgucgugaccaagaaggaggagccggugaacaucgaggccgagccgcccuucggggagagcaacaucgucaucggcaucggcgacaacgcccugaagaucaacugguacaagaagggguccacccugggcaaggcguucagcacgacccugaagggggcccagcggcucgccgcccugggcgacaccgccugggacuucggguccaucggcggcguguucaacagcaucgggcgcgcggugcaccaggucuucggcggggccuuccggacccuguucggcgggauguccuggaucacgcagggccucaugggcgcccugcugcucuggaugggggugaacgcccgcgaccgcagcaucgcccuggcguuccuggccaccggcggggugcucgucuuccuggccaccaacgugcacgccuga

SEQ ID NO: 1565 - RNA, 3081 nt, Artificial Sequence
  derived and/or modified CDS sequence (opt1) from DENV-3 Consensus__SSc-prME-NS1
augaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcgccagguggagaaggucgagacgugggcccugcggcacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucacgccccaggccagcaccaccgaggcgauccugcccgaguacggcacccuggggcucgagugcuccccgcgcaccggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccucaucaagguggaguacaagggcgaggacgugccgugcaagauccccuucagcacggaggacgggcagggcaaggcgcacaacggccgccugaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacauggggugcgucaucaacuggaagggcaaggagcugaagugcggcagcgggaucuucgugaccaacgaggugcacaccuggaccgagcaguacaaguuccaggcggacucccccaagcgccucgccacggccaucgccggcgccugggagaacggggucugcggcauccgcagcaccacccggauggagaaccugcuguggaagcagaucgcgaacgagcucaacuacauccugugggagaacaacaucaagcugaccgugguggucggggacaucaucggcgugcucgagcagggcaagcgcacgcugacgccccagccgauggagcugaaguacuccuggaagaccugggggaaggccaagaucgugaccgccgagacccagaacagcuccuucaucaucgacggccccaacacccccgagugccccagcgucucccgggccuggaacgugugggagguggaggacuacggguucggcgucuucaccaccaacaucuggcucaagcugcgcgagguguacacccagcugugcgaccaccggcucaugagcgcggccgugaaggacgagcgcgccguccacgccgacaugggcuacuggaucgagagccagaagaacggguccuggaagcuggagaaggccagccugaucgaggugaagacgugcaccuggccgaagucccacacccucuggagcaacggcgugcuggaguccgacaugaucauccccaagagccuggcggggcccaucucccagcacaaccaccggccgggcuaccacacccagacggccgggcccuggcaccucggcaagcuggagcuggacuucaacuacugcgagggcaccaccgucgugaucaccgagaacugcgggacgcgcggccccagccuccggaccaccaccguguccgggaagcugauccacgaguggugcugccgcagcugcacgcugcccccgcuccgguacaugggcgaggacgggugcugguacggcauggagauccgccccaucuccgagaaggaggagaacauggucaagagccugguguccgccuga

SEQ ID NO: 1566 - RNA, 1824 nt, Artificial Sequence
  derived and/or modified CDS sequence (opt1) from DENV-3 Consensus__SSm-EdelTM-linker-ferritin
augacccagaagguggucaucuucauccugcucaugcuggugacccccagcaugacgaugcgcugcgugggcgucgggaaccgggacuucguggagggccuguccggggccaccuggguggacgucgugcucgagcacggcgggugcgugaccaccauggccaagaacaagccgacgcuggacaucgagcugcagaagaccgaggcgacccagcucgccacccugcgcaagcugugcaucgagggcaagaucacgaacaucaccaccgacagccggugccccacccagggcgaggccacgcuccccgaggagcaggaccagaacuacgucugcaagcacaccuacguggaccgcggguggggcaacgggugcggccuguucgggaagggcucccuggugaccugcgccaaguuccagugccucgagcccaucgagggcaaggucgugcaguacgagaaccugaaguacaccgugaucaucacgguccacaccggggaccagcaccaggugggcaacgagacccagggggugaccgccgagaucacgccgcaggcgagcaccaccgaggccauccugcccgaguacggcacccucggccuggagugcagcccccggacggggcuggacuucaacgagaugauccuccugaccaugaagaacaaggccuggaugguccaccgccagugguucuucgaccugccccucccguggaccuccggcgccaccacggagacccccaccuggaaccggaaggagcugcuggugaccuucaagaacgcgcacgccaagaagcaggagguggucgugcucgggucccaggagggcgccaugcacacggcccugaccggggccaccgagauccagaacagcggcggcaccuccaucuucgcggggcaccugaagugccgccucaagauggacaagcuggagcugaagggcaugagcuacgccaugugcacgaacaccuucgugcucaagaaggaggucuccgagacccagcacgggaccauccugaucaagguggaguacaagggcgaggacguccccugcaagauccccuucagcaccgaggacgggcagggcaaggcccacaacggccggcugaucacggccaacccgguggugaccaagaaggaggagcccgucaacaucgaggccgagccgcccuucggggaguccaacaucgugaucggcaucggggacaacgcgcucaagaucaacugguacaagaagggcagcuccaucgggaagauguucgaggccaccgcccgcggcgcccggcgcauggccauccugggcgacaccgcgugggacuucgggagcuccggcggggacaucaucaagcugcucaacgagcaggucaacaaggagaugcagagcuccaaccuguacaugagcaugagcuccuggugcuacacgcacagccuggacggcgccggccucuuccuguucgaccacgccgccgaggaguacgagcacgccaagaagcugaucaucuuccucaacgagaacaacgugcccgugcagcugaccuccaucagcgcgcccgagcacaaguucgaggggcugacccagaucuuccagaaggccuacgagcacgagcagcacaucuccgagagcaucaacaacaucguggaccacgccaucaaguccaaggaccacgccaccuucaacuuccuccagugguacgucgcggagcagcacgaggaggaggugcuguucaaggacauccuggacaagaucgagcucaucggcaacgagaaccacgggcuguaccuggccgaccaguacgugaagggcaucgccaagagccggaaguccuga

SEQ ID NO: 1567 - RNA, 1821 nt, Artificial Sequence
  derived and/or modified CDS sequence (opt1) from DENV-3 Consensus__SStPA-WHbcAg-linker-EdelTM
auggacgccaugaagcgcggccugugcugcgugcuccugcugugcggggccgucuucguggacagcgugaccggcauggacaucgaccccuacaaggaguucggguccagcuaccagcuccugaacuuccugccgcucgacuucuuccccgaccugaacgcgcuggucgacaccgccacggcccucuacgaggaggagcugaccggccgggagcacugcagcccccaccacaccgccauccgccaggcccuggugugcugggacgagcucaccaagcugaucgcguggauguccuccaacaucacgagcgagcagguccggaccaucaucgugaaccacgugaacgacaccugggggcugaaggugcgccagucccucugguuccaccugagcugccugaccuucggccagcacacgguccaggaguuccucguguccuucggcguguggauccggacccccgccccguaccgcccgcccaacgcccccauccugagcacccugcccgagcacaccgucaucugcgggggcgggggcuccgggggcggcgggaugcggugcgugggcguggggaaccgcgacuucgucgagggccucagcggcgccacguggguggacgugguccuggagcacgggggcugcgugaccaccauggcgaagaacaagcccacccuggacaucgagcuccagaagacggaggccacccagcuggccacccugcggaagcucugcaucgaggggaagaucaccaacaucacgaccgacucccgcugccccacccagggcgaggccacccugcccgaggagcaggaccagaacuacgugugcaagcacacguacgucgaccggggguggggcaacggcugcgggcuguucggcaaggggagccucgugaccugcgccaaguuccagugccuggagccgaucgagggcaaggugguccaguacgagaaccugaaguacaccgugaucaucaccguccacacgggggaccagcaccaggugggcaacgagacccagggcgugaccgcggagaucacgccccaggccuccaccaccgaggccauccuccccgaguacgggacccugggccuggagugcagcccccgcaccgggcucgacuucaacgagaugauccugcugacgaugaagaacaaggccuggaugguccaccggcagugguucuucgaccucccgcugcccuggaccuccggcgccaccaccgagacccccacguggaaccgcaaggagcugcucgugaccuucaagaacgcgcacgccaagaagcaggagguggucgugcuggggagccaggagggcgccaugcacaccgcccugaccggcgccacggagauccagaacuccgggggcaccagcaucuucgcggggcaccucaagugccggcugaagauggacaagcuggagcucaagggcaugagcuacgccaugugcaccaacaccuucgugcugaagaaggaggucuccgagacgcagcacggcaccauccugaucaagguggaguacaagggggaggacgugcccugcaagaucccguucagcaccgaggacggccaggggaaggcccacaacggccgccugaucaccgccaaccccgucgugacgaagaaggaggagcccgugaacaucgaggccgagcccccguucggggaguccaacaucgucaucggcaucggcgacaacgcgcucaagaucaacugguacaagaaggggagcuccaucggcaagauguucgaggccaccgcccgcggggcccggcggauggcgauccugggcgacaccgccugggacuucgggagcuga

SEQ ID NO: 1568 - RNA, 75 nt, Artificial Sequence
  derived and/or modified CDS sequence (opt2) from Homo sapiens__SigSeq(TPA)/SStPA
auggacgccaugaagcgcggccucugcugcguccuccuccucugcggcgccgucuucgucgacuccgucaccggc

SEQ ID NO: 1569 - RNA, 489 nt, Artificial Sequence
  derived and/or modified CDS sequence (opt2) from Helicobacter pylori J99__Ferritin
gacaucaucaagcuccucaacgagcaggucaacaaggagaugcaguccuccaaccucuacauguccauguccuccuggugcuacacccacucccucgacggcgccggccucuuccucuucgaccacgccgccgaggaguacgagcacgccaagaagcucaucaucuuccucaacgagaacaacguccccguccagcucaccuccaucuccgcccccgagcacaaguucgagggccucacccagaucuuccagaaggccuacgagcacgagcagcacaucuccgaguccaucaacaacaucgucgaccacgccaucaaguccaaggaccacgccaccuucaacuuccuccagugguacgucgccgagcagcacgaggaggagguccucuucaaggacauccucgacaagaucgagcucaucggcaacgagaaccacggccucuaccucgccgaccaguacgucaagggcaucgccaagucccgcaagucc

SEQ ID NO: 1570 - RNA, 450 nt, Artificial Sequence
  derived and/or modified CDS sequence (opt2) from Woodchuck hepatitis virus__WHbcAg
auggacaucgaccccuacaaggaguucggcuccuccuaccagcuccucaacuuccucccccucgacuucuuccccgaccucaacgcccucgucgacaccgccaccgcccucuacgaggaggagcucaccggccgcgagcacugcuccccccaccacaccgccauccgccaggcccucgucugcugggacgagcucaccaagcucaucgccuggauguccuccaacaucaccuccgagcagguccgcaccaucaucgucaaccacgucaacgacaccuggggccucaagguccgccagucccucugguuccaccucuccugccucaccuucggccagcacaccguccaggaguuccucgucuccuucggcgucuggauccgcacccccgcccccuaccgcccccccaacgcccccauccucuccacccuccccgagcacaccgucaucugc

SEQ ID NO: 1571 - RNA, 303 nt, Artificial Sequence
  derived and/or modified CDS sequence (opt2) from Japanese encephalitis virus__Cterm-JEV/JEV
ggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 1572 - RNA, 15 nt, Artificial Sequence
  derived and/or modified CDS sequence (opt2) from Artificial__MKRKK
augaagcgcaagaag

SEQ ID NO: 1573 - RNA, 9 nt, Artificial Sequence
  derived and/or modified CDS sequence (opt2) from Artificial__Linker(SGG)
uccggcggc

SEQ ID NO: 1574 - RNA, 27 nt, Artificial Sequence
  derived and/or modified CDS sequence (opt2) from Artificial__Linker(G4SG4)
ggcggcggcggcuccggcggcggcggc

SEQ ID NO: 1575 - RNA, 51 nt, Artificial Sequence
  derived and/or modified CDS sequence (opt2) from Foot-and-mouth disease virus__F2A/P2A
aacuucgaccuccucaagcucgccggcgacgucgaguccaaccccggcccc

SEQ ID NO: 1576 - RNA, 300 nt, Artificial Sequence
  derived and/or modified CDS sequence (opt2) from DENV-1 CYD23__C
augaacaaccagcgcaagaagaccgcccgccccuccuucaacaugcucaagcgcgcccgcaaccgcgucuccaccgucucccagcucgccaagcgcuucuccaagggccuccucuccggccagggccccaugaagcucgucauggccuucaucgccuuccuccgcuuccucgccaucccccccaccgccggcauccucgcccgcuggggcuccuucaagaagaacggcgccaucaagguccuccgcggcuucaagaaggagaucuccaacaugcucaacaucaugaaccgccgccgcaag

SEQ ID NO: 1577 - RNA, 342 nt, Artificial Sequence
  derived and/or modified CDS sequence (opt2) from DENV-1 CYD23__C-SSc
augaacaaccagcgcaagaagaccgcccgccccuccuucaacaugcucaagcgcgcccgcaaccgcgucuccaccgucucccagcucgccaagcgcuucuccaagggccuccucuccggccagggccccaugaagcucgucauggccuucaucgccuuccuccgcuuccucgccaucccccccaccgccggcauccucgcccgcuggggcuccuucaagaagaacggcgccaucaagguccuccgcggcuucaagaaggagaucuccaacaugcucaacaucaugaaccgccgccgcaaguccgucaccaugcuccucaugcucaugcccaccgcccucgcc

SEQ ID NO: 1578 - RNA, 273 nt, Artificial Sequence
  derived and/or modified CDS sequence (opt2) from DENV-1 CYD23__pr
uuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgc

SEQ ID NO: 1579 - RNA, 225 nt, Artificial Sequence
  derived and/or modified CDS sequence (opt2) from DENV-1 CYD23__M
uccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggcc

SEQ ID NO: 1580 - RNA, 498 nt, Artificial Sequence
  derived and/or modified CDS sequence (opt2) from DENV-1 CYD23__prM
uuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggcc

SEQ ID NO: 1581 - RNA, 1485 nt, Artificial Sequence
  derived and/or modified CDS sequence (opt2) from DENV-1 CYD23__E
augcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggcc

SEQ ID NO: 1582 - RNA, 1983 nt, Artificial Sequence
  derived and/or modified CDS sequence (opt2) from DENV-1 CYD23__prME
uuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggcc

SEQ ID NO: 1583 - RNA, 2025 nt, Artificial Sequence
  derived and/or modified CDS sequence (opt2) from DENV-1 CYD23__SSc-prME
uccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggcc

SEQ ID NO: 1584 - RNA, 2325 nt, Artificial Sequence
  derived and/or modified CDS sequence (opt2) from DENV-1 CYD23__C-prME
augaacaaccagcgcaagaagaccgcccgccccuccuucaacaugcucaagcgcgcccgcaaccgcgucuccaccgucucccagcucgccaagcgcuucuccaagggccuccucuccggccagggccccaugaagcucgucauggccuucaucgccuuccuccgcuuccucgccaucccccccaccgccggcauccucgcccgcuggggcuccuucaagaagaacggcgccaucaagguccuccgcggcuucaagaaggagaucuccaacaugcucaacaucaugaaccgccgccgcaaguccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggcc

SEQ ID NO: 1585 - RNA, 45 nt, Artificial Sequence
  derived and/or modified CDS sequence (opt2) from DENV-1 CYD23__SSc
auguccgucaccaugcuccucaugcucaugcccaccgcccucgcc

SEQ ID NO: 1586 - RNA, 57 nt, Artificial Sequence
  derived and/or modified CDS sequence (opt2) from DENV-1 CYD23__SSopt
augaagcgcaagaaguccgucaccaugcuccucaugcucaugcccaccgcccucgcc

SEQ ID NO: 1587 - RNA, 57 nt, Artificial Sequence
  derived and/or modified CDS sequence (opt2) from DENV-1 CYD23__SSm
augacccagaagggcaucaucuucauccuccucaugcucgucacccccuccauggcc

SEQ ID NO: 1588 - RNA, 1488 nt, Artificial Sequence
  derived and/or modified CDS sequence (opt2) from DENV-1 CYD23__E
augcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccuga

SEQ ID NO: 1589 - RNA, 1182 nt, Artificial Sequence
  derived and/or modified CDS sequence (opt2) from DENV-1 CYD23__EdelTM-variant (aa1-394)
augcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaag

SEQ ID NO: 1590 - RNA, 1275 nt, Artificial Sequence
  derived and/or modified CDS sequence (opt2) from DENV-1 CYD23__EdelTM-variant (aa1-424)
augcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccuga

SEQ ID NO: 1591 - RNA, 1266 nt, Artificial Sequence
  derived and/or modified CDS sequence (opt2) from DENV-1 CYD23__EdelTM-variant (aa1-421)
augcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuga

SEQ ID NO: 1592 - RNA, 2031 nt, Artificial Sequence
  derived and/or modified CDS sequence (opt2) from DENV-1 CYD23__SSc-prME
auguccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccuga

SEQ ID NO: 1593 - RNA, 2031 nt, Artificial Sequence
  derived and/or modified CDS sequence (opt2) from DENV-1 CYD23__SSc-prME(F108S)
auguccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuccggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccuga

SEQ ID NO: 1594 - RNA, 2031 nt, Artificial Sequence
  derived and/or modified CDS sequence (opt2) from DENV-1 CYD23__SSc-prMEdelstem_TM-JEV
auguccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1595 - RNA, 2379 nt, Artificial Sequence
  derived and/or modified CDS sequence (opt2) from DENV-1 CYD23__C-P2A-SSc-prME
augaacaaccagcgcaagaagaccgcccgccccuccuucaacaugcucaagcgcgcccgcaaccgcgucuccaccgucucccagcucgccaagcgcuucuccaagggccuccucuccggccagggccccaugaagcucgucauggccuucaucgccuuccuccgcuuccucgccaucccccccaccgccggcauccucgcccgcuggggcuccuucaagaagaacggcgccaucaagguccuccgcggcuucaagaaggagaucuccaacaugcucaacaucaugaaccgccgccgcaagaacuucgaccuccucaagcucgccggcgacgucgaguccaaccccggccccuccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccuccucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccuga

SEQ ID NO: 1596 - RNA, 2043 nt, Artificial Sequence
  derived and/or modified CDS sequence (opt2) from DENV-1 CYD23__SSopt-prME(F108S)
augaagcgcaagaaguccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuccggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccuga

SEQ ID NO: 1597 - RNA, 2043 nt, Artificial Sequence
  derived and/or modified CDS sequence (opt2) from DENV-1 CYD23__SSopt-prME(F96H)
augaagcgcaagaaguccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcacccacgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccuga

SEQ ID NO: 1598 - RNA, 2043 nt, Artificial Sequence
  derived and/or modified CDS sequence (opt2) from DENV-1 CYD23__SSopt-prME(S186F)
augaagcgcaagaaguccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuucccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccuga

SEQ ID NO: 1599 - RNA, 2043 nt, Artificial Sequence
  derived and/or modified CDS sequence (opt2) from DENV-1 CYD23__SSopt-prME(R188L)
augaagcgcaagaaguccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccucaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccuccaucggcaagauguucgaggccaccgcccgcggcgcccgccgcauggccauccucggcgacaccgccugggacuucggcuccaucggcggcgucuucaccuccgucggcaagcucguccaccagaucuucggcaccgccuacggcguccucuucuccggcgucuccuggaccaugaagaucggcaucggcguccuccucaccuggcucggccucaacucccgcuccaccucccucuccaugaccugcaucgccgucggccucgucacccucuaccucggcgucaugguccaggccuga

SEQ ID NO: 1600 - RNA, 2043 nt, Artificial Sequence
  derived and/or modified CDS sequence (opt2) from DENV-1 CYD23__SSopt-pr(D104A)MEdelstem_TM,(F108S)-JEV
augaagcgcaagaaguccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgccaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuccggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1601 - RNA, 2043 nt, Artificial Sequence
  derived and/or modified CDS sequence (opt2) from DENV-1 CYD23__SSopt-prMEdelstem_TM,(H261N)-JEV
augaagcgcaagaaguccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccgcaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugaacaccgcccucaccggcgccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1602 - RNA, 2043 nt, Artificial Sequence
  derived and/or modified CDS sequence (opt2) from DENV-1 CYD23__SSopt-prMEdelstem_TM,(R188L,A267T)-JEV
augaagcgcaagaaguccgucaccaugcuccucaugcucaugcccaccgcccucgccuuccaccucaccacccgcggcggcgagccccacaugaucgucuccaagcaggagcgcggcaagucccuccucuucaagaccuccgccggcgucaacaugugcacccucaucgccauggaccucggcgagcucugcgaggacaccaugaccuacaagugcccccgcaucaccgaggccgagcccgacgacgucgacugcuggugcaacgccaccgacaccugggucaccuacggcaccugcucccagaccggcgagcaccgccgcgacaagcgcuccgucgcccucgccccccacgucggccucggccucgagacccgcaccgagaccuggauguccuccgagggcgccuggaagcagauccagcgcgucgagaccugggcccuccgccaccccggcuucaccgucaucgcccucuuccucgcccacgccaucggcaccuccaucacccagaagggcaucaucuucauccuccucaugcucgucacccccuccauggccaugcgcugcgucggcaucggcucccgcgacuucgucgagggccucuccggcgccaccugggucgacgucguccucgagcacggcuccugcgucaccaccauggccaaggacaagcccacccucgacaucgagcuccucaagaccgaggucaccaaccccgccguccuccgcaagcucugcaucgaggccaagaucuccaacaccaccaccgacucccgcugccccacccagggcgaggccacccucgucgaggagcaggacgccaacuucgucugccgccgcaccuucgucgaccgcggcuggggcaacggcugcggccucuucggcaagggcucccucaucaccugcgccaaguucaagugcgucaccaagcucgagggcaagaucguccaguacgagaaccucaaguacuccgucaucgucaccguccacaccggcgaccagcaccaggucggcaacgaguccaccgagcacggcaccaccgccaccaucaccccccaggcccccaccaccgagauccagcucaccgacuacggcgcccucacccucgacugcuccccccucaccggccucgacuucaacgagaugguccuccucaccaugaaggagaaguccuggcucguccacaagcagugguuccucgaccucccccuccccuggaccuccggcgccuccaccucccaggagaccuggaaccgccaggaccuccucgucaccuucaagaccgcccacgccaagaagcaggaggucgucguccucggcucccaggagggcgccaugcacaccgcccucaccggcaccaccgagauccagaccuccggcaccaccaccaucuucgccggccaccucaagugccgccucaagauggacaagcucacccucaagggcauguccuacgucaugugcaccggcuccuucaagcucgagaaggaggucgccgagacccagcacggcaccguccucguccagaucaaguacgagggcaccgacgcccccugcaagauccccuucuccacccaggacgagaagggcgucacccagaacggccgccucaucaccgccaaccccaucgucaccgacaaggagaagcccgucaacaucgaggccgagccccccuucggcgaguccuacaucgucaucggcgccggcgagaaggcccucaagcucuccugguucaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1603 - RNA, 300 nt, Artificial Sequence
  derived and/or modified CDS sequence (opt2) from DENV-2 CYD2-T__C
augaacaaccagcgcaagaaggccaagaacacccccuucaacaugcucaagcgcgagcgcaaccgcgucuccaccguccagcagcucaccaagcgcuucucccucggcaugcuccagggccgcggcccccucaagcucuucauggcccucgucgccuuccuccgcuuccucaccaucccccccaccgccggcauccucaagcgcuggggcaccaucaagaaguccaaggccaucaacguccuccgcggcuuccgcaaggagaucggccgcaugcucaacauccucaaccgccgccgccgc

SEQ ID NO: 1604 - RNA, 342 nt, Artificial Sequence
  derived and/or modified CDS sequence (opt2) from DENV-2 CYD2-T__C-SSc
augaacaaccagcgcaagaaggccaagaacacccccuucaacaugcucaagcgcgagcgcaaccgcgucuccaccguccagcagcucaccaagcgcuucucccucggcaugcuccagggccgcggcccccucaagcucuucauggcccucgucgccuuccuccgcuuccucaccaucccccccaccgccggcauccucaagcgcuggggcaccaucaagaaguccaaggccaucaacguccuccgcggcuuccgcaaggagaucggccgcaugcucaacauccucaaccgccgccgccgcuccgccggcaugaucaucaugcucauccccaccgucauggcc

SEQ ID NO: 1605 - RNA, 273 nt, Artificial Sequence
  derived and/or modified CDS sequence (opt2) from DENV-2 CYD2-T__pr
uuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgc

SEQ ID NO: 1606 - RNA, 225 nt, Artificial Sequence
  derived and/or modified CDS sequence (opt2) from DENV-2 CYD2-T__M
uccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugacc

SEQ ID NO: 1607 - RNA, 498 nt, Artificial Sequence
  derived and/or modified CDS sequence (opt2) from DENV-2 CYD2-T__prM
uuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugacc

SEQ ID NO: 1608 - RNA, 1485 nt, Artificial Sequence
  derived and/or modified CDS sequence (opt2) from DENV-2 CYD2-T__E
augcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggcc

SEQ ID NO: 1609 - RNA, 1983 nt, Artificial Sequence
  derived and/or modified CDS sequence (opt2) from DENV-2 CYD2-T__prME
uuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggcc

SEQ ID NO: 1610 - RNA, 2025 nt, Artificial Sequence
  derived and/or modified CDS sequence (opt2) from DENV-2 CYD2-T__SSc-prME
uccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggcc

SEQ ID NO: 1611 - RNA, 2325 nt, Artificial Sequence
  derived and/or modified CDS sequence (opt2) from DENV-2 CYD2-T__C-prME
augaacaaccagcgcaagaaggccaagaacacccccuucaacaugcucaagcgcgagcgcaaccgcgucuccaccguccagcagcucaccaagcgcuucucccucggcaugcuccagggccgcggcccccucaagcucuucauggcccucgucgccuuccuccgcuuccucaccaucccccccaccgccggcauccucaagcgcuggggcaccaucaagaaguccaaggccaucaacguccuccgcggcuuccgcaaggagaucggccgcaugcucaacauccucaaccgccgccgccgcuccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggcc

SEQ ID NO: 1612 - RNA, 45 nt, Artificial Sequence
  derived and/or modified CDS sequence (opt2) from DENV-2 CYD2-T__SSc
auguccgccggcaugaucaucaugcucauccccaccgucauggcc

SEQ ID NO: 1613 - RNA, 57 nt, Artificial Sequence
  derived and/or modified CDS sequence (opt2) from DENV-2 CYD2-T__SSopt
augaagcgcaagaaguccgccggcaugaucaucaugcucauccccaccgucauggcc

SEQ ID NO: 1614 - RNA, 57 nt, Artificial Sequence
  derived and/or modified CDS sequence (opt2) from DENV-2 CYD2-T__SSm
auguuccagcgcgcccucaucuucauccuccucaccgccgucacccccuccaugacc

SEQ ID NO: 1615 - RNA, 1488 nt, Artificial Sequence
  derived and/or modified CDS sequence (opt2) from DENV-2 CYD2-T__E
augcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggccuga

SEQ ID NO: 1616 - RNA, 1182 nt, Artificial Sequence
  derived and/or modified CDS sequence (opt2) from DENV-2 CYD2-T__EdelTM-variant (aa1-394)
augcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaag

SEQ ID NO: 1617 - RNA, 1272 nt, Artificial Sequence
  derived and/or modified CDS sequence (opt2) from DENV-2 CYD2-T__EdelTM-variant (aa1-424)
augcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucc

SEQ ID NO: 1618 - RNA, 1263 nt, Artificial Sequence
  derived and/or modified CDS sequence (opt2) from DENV-2 CYD2-T__EdelTM-variant (aa1-421)
augcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggac

SEQ ID NO: 1619 - RNA, 2031 nt, Artificial Sequence
  derived and/or modified CDS sequence (opt2) from DENV-2 CYD2-T__SSc-prME
auguccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggccuga

SEQ ID NO: 1620 - RNA, 2031 nt, Artificial Sequence
  derived and/or modified CDS sequence (opt2) from DENV-2 CYD2-T__SSc-prME(F108S)
auguccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuccggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggccuga

SEQ ID NO: 1621 - RNA, 2031 nt, Artificial Sequence
  derived and/or modified CDS sequence (opt2) from DENV-2 CYD2-T__SSc-prMEdelstem_TM-JEV
auguccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1622 - RNA, 1332 nt, Artificial Sequence
  derived and/or modified CDS sequence (opt2) from DENV-2 CYD2-T__SSm-EdelTM
auguuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcuccuga

SEQ ID NO: 1623 - RNA, 2379 nt, Artificial Sequence
  derived and/or modified CDS sequence (opt2) from DENV-2 CYD2-T__C-P2A-SSc-prME
augaacaaccagcgcaagaaggccaagaacacccccuucaacaugcucaagcgcgagcgcaaccgcgucuccaccguccagcagcucaccaagcgcuucucccucggcaugcuccagggccgcggcccccucaagcucuucauggcccucgucgccuuccuccgcuuccucaccaucccccccaccgccggcauccucaagcgcuggggcaccaucaagaaguccaaggccaucaacguccuccgcggcuuccgcaaggagaucggccgcaugcucaacauccucaaccgccgccgccgcaacuucgaccuccucaagcucgccggcgacgucgaguccaaccccggccccuccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggccuga

SEQ ID NO: 1624 - RNA, 2043 nt, Artificial Sequence
  derived and/or modified CDS sequence (opt2) from DENV-2 CYD2-T__SSopt-prME(F108S)
augaagcgcaagaaguccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuccggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggccuga

SEQ ID NO: 1625 - RNA, 2043 nt, Artificial Sequence
  derived and/or modified CDS sequence (opt2) from DENV-2 CYD2-T__SSopt-prME(M96H)
augaagcgcaagaaguccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacucccacgucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggccuga

SEQ ID NO: 1626 - RNA, 2043 nt, Artificial Sequence
  derived and/or modified CDS sequence (opt2) from DENV-2 CYD2-T__SSopt-prME(S186F)
augaagcgcaagaaguccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuucccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggccuga

SEQ ID NO: 1627 - RNA, 2043 nt, Artificial Sequence
  derived and/or modified CDS sequence (opt2) from DENV-2 CYD2-T__SSopt-prME(R188L)
augaagcgcaagaaguccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccucaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccuccaucggccagauguucgagaccaccaugcgcggcgccaagcgcauggccauccucggcgacaccgccugggacuucggcucccucggcggcgucuucaccuccaucggcaaggcccuccaccaggucuucggcgccaucuacggcgccgccuucuccggcgucuccuggaccaugaagauccucaucggcgucaucaucaccuggaucggcaugaacucccgcuccaccucccucuccgucacccucguccucgucggcaucgucacccucuaccucggcgucaugguccaggccuga

SEQ ID NO: 1628 - RNA, 2043 nt, Artificial Sequence
  derived and/or modified CDS sequence (opt2) from DENV-2 CYD2-T__SSopt-pr(D104A)MEdelstem_TM,(F108S)-JEV
augaagcgcaagaaguccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgccaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuccggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1629 - RNA, 2043 nt, Artificial Sequence
  derived and/or modified CDS sequence (opt2) from DENV-2 CYD2-T__SSopt-prMEdelstem_TM,(H261N)-JEV
augaagcgcaagaaguccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccgcaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugaacaccgcccucaccggcgccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1630 - RNA, 2043 nt, Artificial Sequence
  derived and/or modified CDS sequence (opt2) from DENV-2 CYD2-T__SSopt-prMEdelstem_TM,(R188L,A267T)-JEV
augaagcgcaagaaguccgccggcaugaucaucaugcucauccccaccgucauggccuuccaccucaccacccgcaacggcgagccccacaugaucgucucccgccaggagaagggcaagucccuccucuucaagaccgaggacggcgucaacaugugcacccucauggccauggaccucggcgagcucugcgaggacaccaucaccuacaagugcccccuccuccgccagaacgagcccgaggacaucgacugcuggugcaacuccaccuccaccugggucaccuacggcaccugcaccaccaugggcgagcaccgccgcgagaagcgcuccgucgcccucgucccccacgucggcaugggccucgagacccgcaccgagaccuggauguccuccgagggcgccuggaagcacguccagcgcaucgagaccuggauccuccgccaccccggcuucaccaugauggccgccauccucgccuacaccaucggcaccacccacuuccagcgcgcccucaucuucauccuccucaccgccgucacccccuccaugaccaugcgcugcaucggcauguccaaccgcgacuucgucgagggcgucuccggcggcuccugggucgacaucguccucgagcacggcuccugcgucaccaccauggccaagaacaagcccacccucgacuucgagcucaucaagaccgaggccaagcagcccgccacccuccgcaaguacugcaucgaggccaagcucaccaacaccaccaccgagucccgcugccccacccagggcgagcccucccucaacgaggagcaggacaagcgcuucgucugcaagcacuccauggucgaccgcggcuggggcaacggcugcggccucuucggcaagggcggcaucgucaccugcgccauguuccgcugcaagaagaacauggagggcaaggucguccagcccgagaaccucgaguacaccaucgucaucaccccccacuccggcgaggagcacgccgucggcaacgacaccggcaagcacggcaaggagaucaagaucaccccccaguccuccaucaccgaggccgagcucaccggcuacggcaccgucaccauggagugcuccccccucaccggccucgacuucaacgagaugguccuccuccagauggagaacaaggccuggcucguccaccgccagugguuccucgaccucccccuccccuggcuccccggcgccgacacccagggcuccaacuggauccagaaggagacccucgucaccuucaagaacccccacgccaagaagcaggacgucgucguccucggcucccaggagggcgccaugcacaccgcccucaccggcaccaccgagauccagauguccuccggcaaccuccucuucaccggccaccucaagugccgccuccgcauggacaagcuccagcucaagggcauguccuacuccaugugcaccggcaaguucaaggucgucaaggagaucgccgagacccagcacggcaccaucgucauccgcguccaguacgagggcgacggcucccccugcaagauccccuucgagaucauggaccucgagaagcgccacguccucggccgccucaucaccgucaaccccaucgucaccgagaaggacucccccgucaacaucgaggccgagccccccuucggcgacuccuacaucaucaucggcgucgagcccggccagcucaagcucaacugguucaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1631 - RNA, 297 nt, Artificial Sequence
  derived and/or modified CDS sequence (opt2) from DENV-4 Consensus__C
augaaccagcgcaagaaggucguccgcccccccuucaacaugcucaagcgcgagcgcaaccgcgucuccaccccccagggccucgucaagcgcuucuccaccggccucuucuccggcaagggcccccuccgcaugguccucgccuucaucaccuuccuccgcguccucuccaucccccccaccgccggcauccucaagcgcuggggccagcucaagaagaacaaggccaucaagauccucaucggcuuccgcaaggagaucggccgcaugcucaacauccucaacggccgcaagcgc

SEQ ID NO: 1632 - RNA, 339 nt, Artificial Sequence
  derived and/or modified CDS sequence (opt2) from DENV-4 Consensus__C-SSc
augaaccagcgcaagaaggucguccgcccccccuucaacaugcucaagcgcgagcgcaaccgcgucuccaccccccagggccucgucaagcgcuucuccaccggccucuucuccggcaagggcccccuccgcaugguccucgccuucaucaccuuccuccgcguccucuccaucccccccaccgccggcauccucaagcgcuggggccagcucaagaagaacaaggccaucaagauccucaucggcuuccgcaaggagaucggccgcaugcucaacauccucaacggccgcaagcgcuccaccaucacccuccucugccucauccccaccgucauggcc

SEQ ID NO: 1633 - RNA, 273 nt, Artificial Sequence
  derived and/or modified CDS sequence (opt2) from DENV-4 Consensus__pr
uuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgc

SEQ ID NO: 1634 - RNA, 225 nt, Artificial Sequence
  derived and/or modified CDS sequence (opt2) from DENV-4 Consensus__M
uccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggc

SEQ ID NO: 1635 - RNA, 498 nt, Artificial Sequence
  derived and/or modified CDS sequence (opt2) from DENV-4 Consensus__prM
uuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggc

SEQ ID NO: 1636 - RNA, 1485 nt, Artificial Sequence
  derived and/or modified CDS sequence (opt2) from DENV-4 Consensus__E
augcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggcc

SEQ ID NO: 1637 - RNA, 1983 nt, Artificial Sequence
  derived and/or modified CDS sequence (opt2) from DENV-4 Consensus__prME
uuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggcc

SEQ ID NO: 1638 - RNA, 2025 nt, Artificial Sequence
  derived and/or modified CDS sequence (opt2) from DENV-4 Consensus__SSc-prME
uccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggcc

SEQ ID NO: 1639 - RNA, 2322 nt, Artificial Sequence
  derived and/or modified CDS sequence (opt2) from DENV-4 Consensus__C-prME
augaaccagcgcaagaaggucguccgcccccccuucaacaugcucaagcgcgagcgcaaccgcgucuccaccccccagggccucgucaagcgcuucuccaccggccucuucuccggcaagggcccccuccgcaugguccucgccuucaucaccuuccuccgcguccucuccaucccccccaccgccggcauccucaagcgcuggggccagcucaagaagaacaaggccaucaagauccucaucggcuuccgcaaggagaucggccgcaugcucaacauccucaacggccgcaagcgcuccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggcc

SEQ ID NO: 1640 - RNA, 45 nt, Artificial Sequence
  derived and/or modified CDS sequence (opt2) from DENV-4 Consensus__SSc
auguccaccaucacccuccucugccucauccccaccgucauggcc

SEQ ID NO: 1641 - RNA, 57 nt, Artificial Sequence
  derived and/or modified CDS sequence (opt2) from DENV-4 Consensus__SSopt
augaagcgcaagaaguccaccaucacccuccucugccucauccccaccgucauggcc

SEQ ID NO: 1642 - RNA, 57 nt, Artificial Sequence
  derived and/or modified CDS sequence (opt2) from DENV-4 Consensus__SSm
augauccagcgcaccgucuucuucguccucaugaugcucgucgcccccuccuacggc

SEQ ID NO: 1643 - RNA, 1488 nt, Artificial Sequence
  derived and/or modified CDS sequence (opt2) from DENV-4 Consensus__E
augcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccuga

SEQ ID NO: 1644 - RNA, 1182 nt, Artificial Sequence
  derived and/or modified CDS sequence (opt2) from DENV-4 Consensus__EdelTM-variant (aa1-394)
augcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaag

SEQ ID NO: 1645 - RNA, 1272 nt, Artificial Sequence
  derived and/or modified CDS sequence (opt2) from DENV-4 Consensus__EdelTM-variant (aa1-424)
augcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcucc

SEQ ID NO: 1646 - RNA, 1266 nt, Artificial Sequence
  derived and/or modified CDS sequence (opt2) from DENV-4 Consensus__EdelTM-variant (aa1-421)
augcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuga

SEQ ID NO: 1647 - RNA, 2031 nt, Artificial Sequence
  derived and/or modified CDS sequence (opt2) from DENV-4 Consensus__SSc-prME
auguccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccuga

SEQ ID NO: 1648 - RNA, 2031 nt, Artificial Sequence
  derived and/or modified CDS sequence (opt2) from DENV-4 Consensus__SSc-prME(F108S)
auguccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuccggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccuga

SEQ ID NO: 1649 - RNA, 2031 nt, Artificial Sequence
  derived and/or modified CDS sequence (opt2) from DENV-4 Consensus__SSc-prMEdelstem_TM-JEV
auguccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1650 - RNA, 1332 nt, Artificial Sequence
  derived and/or modified CDS sequence (opt2) from DENV-4 Consensus__SSm-EdelTM
augauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccuga

SEQ ID NO: 1651 - RNA, 2376 nt, Artificial Sequence
  derived and/or modified CDS sequence (opt2) from DENV-4 Consensus__C-P2A-SSc-prME
augaaccagcgcaagaaggucguccgcccccccuucaacaugcucaagcgcgagcgcaaccgcgucuccaccccccagggccucgucaagcgcuucuccaccggccucuucuccggcaagggcccccuccgcaugguccucgccuucaucaccuuccuccgcguccucuccaucccccccaccgccggcauccucaagcgcuggggccagcucaagaagaacaaggccaucaagauccucaucggcuuccgcaaggagaucggccgcaugcucaacauccucaacggccgcaagcgcaacuucgaccuccucaagcucgccggcgacgucgaguccaaccccggccccuccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccuga

SEQ ID NO: 1652 - RNA, 2043 nt, Artificial Sequence
  derived and/or modified CDS sequence (opt2) from DENV-4 Consensus__SSopt-prME(F108S)
augaagcgcaagaaguccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuccggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccuga

SEQ ID NO: 1653 - RNA, 2043 nt, Artificial Sequence
  derived and/or modified CDS sequence (opt2) from DENV-4 Consensus__SSopt-prME(V96H)
augaagcgcaagaaguccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgaccacgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccuga

SEQ ID NO: 1654 - RNA, 2043 nt, Artificial Sequence
  derived and/or modified CDS sequence (opt2) from DENV-4 Consensus__SSopt-prME(E186F)
augaagcgcaagaaguccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcuucccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccuga

SEQ ID NO: 1655 - RNA, 2043 nt, Artificial Sequence
  derived and/or modified CDS sequence (opt2) from DENV-4 Consensus__SSopt-prME(R188L)
augaagcgcaagaaguccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccucuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccuccaucggcaagauguucgaguccaccuaccgcggcgccaagcgcauggccauccucggcgagaccgccugggacuucggcuccgucggcggccucuucaccucccucggcaaggccguccaccaggucuucggcuccgucuacaccaccauguucggcggcgucuccuggaugauccgcauccucaucggcuuccucguccucuggaucggcaccaacucccgcaacaccuccauggccaugaccugcaucgccgucggcggcaucacccucuuccucggcuucaccguccaggccuga

SEQ ID NO: 1656 - RNA, 2043 nt, Artificial Sequence
  derived and/or modified CDS sequence (opt2) from DENV-4 Consensus__SSopt-pr(D104A)MEdelstem_TM,(F108S)-JEV
augaagcgcaagaaguccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgccaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuccggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1657 - RNA, 2043 nt, Artificial Sequence
  derived and/or modified CDS sequence (opt2) from DENV-4 Consensus__SSopt-prMEdelstem_TM,(H261N)-JEV
augaagcgcaagaaguccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccgcuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugaacuccgcccucgccggcgccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1658 - RNA, 2043 nt, Artificial Sequence
  derived and/or modified CDS sequence (opt2) from DENV-4 Consensus__SSopt-prMEdelstem_TM,(R188L,A267T)-JEV
augaagcgcaagaaguccaccaucacccuccucugccucauccccaccgucauggccuuccaccucuccacccgcgacggcgagccccucaugaucgucgccaagcacgagcgcggccgcccccuccucuucaagaccaccgagggcaucaacaagugcacccucaucgccauggaccucggcgagaugugcgaggacaccgucaccuacaagugcccccuccucgucaacaccgagcccgaggacaucgacugcuggugcaaccucaccuccaccugggucauguacggcaccugcacccaguccggcgagcgccgccgcgagaagcgcuccgucgcccucaccccccacuccggcaugggccucgagacccgcgccgagaccuggauguccuccgagggcgccuggaagcacgcccagcgcgucgaguccuggauccuccgcaaccccggcuucgcccuccucgccggcuucauggccuacaugaucggccagaccggcauccagcgcaccgucuucuucguccucaugaugcucgucgcccccuccuacggcaugcgcugcgucggcgucggcaaccgcgacuucgucgagggcgucuccggcggcgccugggucgaccucguccucgagcacggcggcugcgucaccaccauggcccagggcaagcccacccucgacuucgagcucaccaagaccaccgccaaggaggucgcccuccuccgcaccuacugcaucgaggccuccaucuccaacaucaccaccgccacccgcugccccacccagggcgagcccuaccucaaggaggagcaggaccagcaguacaucugccgccgcgacgucgucgaccgcggcuggggcaacggcugcggccucuucggcaagggcggcgucgucaccugcgccaaguucuccugcuccggcaagaucaccggcaaccucguccagaucgagaaccucgaguacaccgucgucgucaccguccacaacggcgacacccacgccgucggcaacgacaccuccaaccacggcgucaccgccaccaucaccccccgcucccccuccgucgaggucaagcuccccgacuacggcgagcucacccucgacugcgagccccucuccggcaucgacuucaacgagaugauccucaugaagaugaagaagaagaccuggcucguccacaagcagugguuccucgaccucccccuccccuggaccgccggcgccgacaccuccgagguccacuggaacuacaaggagcgcauggucaccuucaaggucccccacgccaagcgccaggacgucaccguccucggcucccaggagggcgccaugcacuccgcccucgccggcaccaccgaggucgacuccggcgacggcaaccacauguucgccggccaccucaagugcaagguccgcauggagaagcuccgcaucaagggcauguccuacaccaugugcuccggcaaguucuccaucgacaaggagauggccgagacccagcacggcaccaccgucgucaaggucaaguacgagggcgccggcgcccccugcaagguccccaucgagauccgcgacgucaacaaggagaaggucgucggccgcgucaucuccuccaccccccucgccgagaacaccaacuccgucaccaacaucgagcucgagccccccuucggcgacuccuacaucgucaucggcgucggcaacuccgcccucacccuccacugguuccgcaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1659 - RNA, 300 nt, Artificial Sequence
  derived and/or modified CDS sequence (opt2) from DENV-3 Consensus__C
augaacaaccagcgcaagaagaccggcaagcccuccaucaacaugcucaagcgcguccgcaaccgcgucuccaccggcucccagcucgccaagcgcuucuccaagggccuccucaacggccagggccccaugaagcucgucauggccuucaucgccuuccuccgcuuccucgccaucccccccaccgccggcguccucgcccgcuggggcaccuucaagaaguccggcgccaucaagguccucaagggcuucaagaaggagaucuccaacaugcucuccaucaucaacaagcgcaagaag

SEQ ID NO: 1660 - RNA, 342 nt, Artificial Sequence
  derived and/or modified CDS sequence (opt2) from DENV-3 Consensus__C-SSc
augaacaaccagcgcaagaagaccggcaagcccuccaucaacaugcucaagcgcguccgcaaccgcgucuccaccggcucccagcucgccaagcgcuucuccaagggccuccucaacggccagggccccaugaagcucgucauggccuucaucgccuuccuccgcuuccucgccaucccccccaccgccggcguccucgcccgcuggggcaccuucaagaaguccggcgccaucaagguccucaagggcuucaagaaggagaucuccaacaugcucuccaucaucaacaagcgcaagaagaccucccucugccucaugaugauccuccccgccgcccucgcc

SEQ ID NO: 1661 - RNA, 273 nt, Artificial Sequence
  derived and/or modified CDS sequence (opt2) from DENV-3 Consensus__pr
uuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgc

SEQ ID NO: 1662 - RNA, 225 nt, Artificial Sequence
  derived and/or modified CDS sequence (opt2) from DENV-3 Consensus__M
uccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugacc

SEQ ID NO: 1663 - RNA, 498 nt, Artificial Sequence
  derived and/or modified CDS sequence (opt2) from DENV-3 Consensus__prM
uuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugacc

SEQ ID NO: 1664 - RNA, 1479 nt, Artificial Sequence
  derived and/or modified CDS sequence (opt2) from DENV-3 Consensus__E
augcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggcc

SEQ ID NO: 1665 - RNA, 1977 nt, Artificial Sequence
  derived and/or modified CDS sequence (opt2) from DENV-3 Consensus__prME
uuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggcc

SEQ ID NO: 1666 - RNA, 2019 nt, Artificial Sequence
  derived and/or modified CDS sequence (opt2) from DENV-3 Consensus__SSc-prME
accucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggcc

SEQ ID NO: 1667 - RNA, 1056 nt, Artificial Sequence
  derived and/or modified CDS sequence (opt2) from DENV-3 Consensus__NS1
gacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgcc

SEQ ID NO: 1668 - RNA, 1857 nt, Artificial Sequence
  derived and/or modified CDS sequence (opt2) from DENV-3 Consensus__NS3
uccggcguccucugggacguccccuccccccccgagacccagaaggccgagcucgaggagggcgucuaccgcaucaagcagcagggcaucuucggcaagacccaggucggcgucggcguccagaaggagggcgucuuccacaccauguggcacgucacccgcggcgccguccucaccuacaacggcaagcgccucgagcccaacugggccuccgucaagaaggaccucaucuccuacggcggcggcuggcgccucuccgcccaguggcagaagggcgaggagguccaggucaucgccgucgagcccggcaagaaccccaagaacuuccagaccaugcccggcaccuuccagaccaccaccggcgagaucggcgccaucgcccucgacuucaagcccggcaccuccggcucccccaucaucaaccgcgagggcaaggucgucggccucuacggcaacggcgucgucaccaagaacggcggcuacgucuccggcaucgcccagaccaacgccgagcccgacggccccacccccgagcucgaggaggagauguucaagaagcgcaaccucaccaucauggaccuccaccccggcuccggcaagacccgcaaguaccuccccgccaucguccgcgaggccaucaagcgccgccuccgcacccucauccucgcccccacccgcgucgucgccgccgagauggaggaggcccucaagggccuccccauccgcuaccagaccaccgccaccaaguccgagcacaccggccgcgagaucgucgaccucaugugccacgccaccuucaccaugcgccuccucucccccguccgcguccccaacuacaaccucaucaucauggacgaggcccacuucaccgaccccgccuccaucgccgcccgcggcuacaucuccacccgcgucggcaugggcgaggccgccgccaucuucaugaccgccaccccccccggcaccgccgacgccuucccccaguccaacgcccccauccaggacgaggagcgcgacauccccgagcgcuccuggaacuccggcaacgaguggaucaccgacuucgccggcaagaccgucugguucguccccuccaucaaggccggcaacgacaucgccaacugccuccgcaagaacggcaagaaggucauccagcucucccgcaagaccuucgacaccgaguaccagaagaccaagcucaacgacugggacuucgucgucaccaccgacaucuccgagaugggcgccaacuucaaggccgaccgcgucaucgacccccgccgcugccucaagcccgucauccucaccgacggccccgagcgcgucauccucgccggccccaugcccgucaccgccgccuccgccgcccagcgccgcggccgcgucggccgcaacccccagaaggagaacgaccaguacaucuucaccggccagccccucaacaacgacgaggaccacgcccacuggaccgaggccaagaugcuccucgacaacaucaacacccccgagggcaucauccccgcccucuucgagcccgagcgcgagaaguccgccgccaucgacggcgaguaccgccucaagggcgagucccgcaagaccuucgucgagcucaugcgccgcggcgaccuccccgucuggcucgcccacaaggucgccuccgagggcaucaaguacaccgaccgcaaguggugcuucgacggccagcgcaacaaccagauccucgaggagaacauggacgucgagaucuggaccaaggagggcgagaagaagaagcuccgcccccgcuggcucgacgcccgcaccuacuccgacccccucgcccucaaggaguucaaggaguucgccgccggccgcaag

SEQ ID NO: 1669 - RNA, 2319 nt, Artificial Sequence
  derived and/or modified CDS sequence (opt2) from DENV-3 Consensus__C-prME
augaacaaccagcgcaagaagaccggcaagcccuccaucaacaugcucaagcgcguccgcaaccgcgucuccaccggcucccagcucgccaagcgcuucuccaagggccuccucaacggccagggccccaugaagcucgucauggccuucaucgccuuccuccgcuuccucgccaucccccccaccgccggcguccucgcccgcuggggcaccuucaagaaguccggcgccaucaagguccucaagggcuucaagaaggagaucuccaacaugcucuccaucaucaacaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggcc

SEQ ID NO: 1670 - RNA, 45 nt, Artificial Sequence
  derived and/or modified CDS sequence (opt2) from DENV-3 Consensus__SSc
augaccucccucugccucaugaugauccuccccgccgcccucgcc

SEQ ID NO: 1671 - RNA, 57 nt, Artificial Sequence
  derived and/or modified CDS sequence (opt2) from DENV-3 Consensus__SSopt
augaagcgcaagaagaccucccucugccucaugaugauccuccccgccgcccucgcc

SEQ ID NO: 1672 - RNA, 57 nt, Artificial Sequence
  derived and/or modified CDS sequence (opt2) from DENV-3 Consensus__SSm
augacccagaaggucgucaucuucauccuccucaugcucgucacccccuccaugacc

SEQ ID NO: 1673 - RNA, 1482 nt, Artificial Sequence
  derived and/or modified CDS sequence (opt2) from DENV-3 Consensus__E
augcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1674 - RNA, 1176 nt, Artificial Sequence
  derived and/or modified CDS sequence (opt2) from DENV-3 Consensus__EdelTM-variant (aa1-392)
augcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaag

SEQ ID NO: 1675 - RNA, 1269 nt, Artificial Sequence
  derived and/or modified CDS sequence (opt2) from DENV-3 Consensus__EdelTM-variant (aa1-422)
augcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccuga

SEQ ID NO: 1676 - RNA, 1260 nt, Artificial Sequence
  derived and/or modified CDS sequence (opt2) from DENV-3 Consensus__EdelTM-variant (aa1-419)
augcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuga

SEQ ID NO: 1677 - RNA, 1155 nt, Artificial Sequence
  derived and/or modified CDS sequence (opt2) from DENV-3 Consensus__Edelaa101-107
augcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaag

SEQ ID NO: 1678 - RNA, 1173 nt, Artificial Sequence
  derived and/or modified CDS sequence (opt2) from DENV-3 Consensus__EdelTM-variant (aa1-391)
augcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaag

SEQ ID NO: 1679 - RNA, 2025 nt, Artificial Sequence
  derived and/or modified CDS sequence (opt2) from DENV-3 Consensus__SSc-prME
augaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1680 - RNA, 2025 nt, Artificial Sequence
  derived and/or modified CDS sequence (opt2) from DENV-3 Consensus__SSc-prME(F108S)
augaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuccggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1681 - RNA, 2025 nt, Artificial Sequence
  derived and/or modified CDS sequence (opt2) from DENV-3 Consensus__SSc-prME(R186L)
augaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccucaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1682 - RNA, 2025 nt, Artificial Sequence
  derived and/or modified CDS sequence (opt2) from DENV-3 Consensus__SSc-prME(A265T)
augaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcaccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1683 - RNA, 2025 nt, Artificial Sequence
  derived and/or modified CDS sequence (opt2) from DENV-3 Consensus__SSc-prMEdelstem_TM-JEV
augaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1684 - RNA, 1326 nt, Artificial Sequence
  derived and/or modified CDS sequence (opt2) from DENV-3 Consensus__SSm-EdelTM
augacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccuga

SEQ ID NO: 1685 - RNA, 2373 nt, Artificial Sequence
  derived and/or modified CDS sequence (opt2) from DENV-3 Consensus__C-P2A-SSc-prME
augaacaaccagcgcaagaagaccggcaagcccuccaucaacaugcucaagcgcguccgcaaccgcgucuccaccggcucccagcucgccaagcgcuucuccaagggccuccucaacggccagggccccaugaagcucgucauggccuucaucgccuuccuccgcuuccucgccaucccccccaccgccggcguccucgcccgcuggggcaccuucaagaaguccggcgccaucaagguccucaagggcuucaagaaggagaucuccaacaugcucuccaucaucaacaagcgcaagaagaacuucgaccuccucaagcucgccggcgacgucgaguccaaccccggccccaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1686 - RNA, 2037 nt, Artificial Sequence
  derived and/or modified CDS sequence (opt2) from DENV-3 Consensus__SSopt-prME
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1687 - RNA, 2037 nt, Artificial Sequence
  derived and/or modified CDS sequence (opt2) from DENV-3 Consensus__SSopt-prME(F108S)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuccggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1688 - RNA, 2037 nt, Artificial Sequence
  derived and/or modified CDS sequence (opt2) from DENV-3 Consensus__SSopt-prME(H27N)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagaacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1689 - RNA, 2037 nt, Artificial Sequence
  derived and/or modified CDS sequence (opt2) from DENV-3 Consensus__SSopt-prME(T76I)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccauccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1690 - RNA, 2037 nt, Artificial Sequence
  derived and/or modified CDS sequence (opt2) from DENV-3 Consensus__SSopt-prME(N89D)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccaggacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1691 - RNA, 2037 nt, Artificial Sequence
  derived and/or modified CDS sequence (opt2) from DENV-3 Consensus__SSopt-prME(Y96H)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacacccacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1692 - RNA, 2037 nt, Artificial Sequence
  derived and/or modified CDS sequence (opt2) from DENV-3 Consensus__SSopt-prME(K110E)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcgagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1693 - RNA, 2037 nt, Artificial Sequence
  derived and/or modified CDS sequence (opt2) from DENV-3 Consensus__SSopt-prME(H149N)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagaaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1694 - RNA, 2037 nt, Artificial Sequence
  derived and/or modified CDS sequence (opt2) from DENV-3 Consensus__SSopt-prME(S184F)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuucccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1695 - RNA, 2037 nt, Artificial Sequence
  derived and/or modified CDS sequence (opt2) from DENV-3 Consensus__SSopt-prME(R186L)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccucaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1696 - RNA, 2037 nt, Artificial Sequence
  derived and/or modified CDS sequence (opt2) from DENV-3 Consensus__SSopt-prME(N240S)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaaguccgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1697 - RNA, 2037 nt, Artificial Sequence
  derived and/or modified CDS sequence (opt2) from DENV-3 Consensus__SSopt-prME(M258L)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgcccuccacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1698 - RNA, 2037 nt, Artificial Sequence
  derived and/or modified CDS sequence (opt2) from DENV-3 Consensus__SSopt-prME(H259N)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugaacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1699 - RNA, 2037 nt, Artificial Sequence
  derived and/or modified CDS sequence (opt2) from DENV-3 Consensus__SSopt-prME(H259R)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcgcaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1700 - RNA, 2037 nt, Artificial Sequence
  derived and/or modified CDS sequence (opt2) from DENV-3 Consensus__SSopt-prME(A265T)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcaccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1701 - RNA, 2037 nt, Artificial Sequence
  derived and/or modified CDS sequence (opt2) from DENV-3 Consensus__SSopt-prME(S296G)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcaugggcuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1702 - RNA, 2037 nt, Artificial Sequence
  derived and/or modified CDS sequence (opt2) from DENV-3 Consensus__SSopt-prME(S311R)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggagguccgcgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1703 - RNA, 2037 nt, Artificial Sequence
  derived and/or modified CDS sequence (opt2) from DENV-3 Consensus__SSopt-prME(K321T)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaccgucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1704 - RNA, 2037 nt, Artificial Sequence
  derived and/or modified CDS sequence (opt2) from DENV-3 Consensus__SSopt-prME(G28C,H242C)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacugcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgccugcgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1705 - RNA, 2037 nt, Artificial Sequence
  derived and/or modified CDS sequence (opt2) from DENV-3 Consensus__SSopt-prME(R186L,A265T)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccucaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcaccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1706 - RNA, 2037 nt, Artificial Sequence
  derived and/or modified CDS sequence (opt2) from DENV-3 Consensus__SSopt-pr(D104A)ME(F108S)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgccaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuccggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1707 - RNA, 2037 nt, Artificial Sequence
  derived and/or modified CDS sequence (opt2) from DENV-3 Consensus__SSopt-pr(D104A)ME(R186L,A265T)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgccaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccucaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcaccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1708 - RNA, 2037 nt, Artificial Sequence
  derived and/or modified CDS sequence (opt2) from DENV-3 Consensus__SSopt-pr(D104A)ME(F108S,R186L,A265T)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgccaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuccggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccucaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcaccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1709 - RNA, 2016 nt, Artificial Sequence
  derived and/or modified CDS sequence (opt2) from DENV-3 Consensus__SSopt-prMEdel101-107,(R99P,F108N)
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccccggcaacggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccuga

SEQ ID NO: 1710 - RNA, 2037 nt, Artificial Sequence
  derived and/or modified CDS sequence (opt2) from DENV-3 Consensus__SSopt-prMEdelstem_TM-JEV
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1711 - RNA, 2037 nt, Artificial Sequence
  derived and/or modified CDS sequence (opt2) from DENV-3 Consensus__SSopt-pr(D104A)MEdelstem_TM,(F108S)-JEV
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgccaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuccggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1712 - RNA, 2037 nt, Artificial Sequence
  derived and/or modified CDS sequence (opt2) from DENV-3 Consensus__SSopt-pr(D104A)MEdelstem_TM,(R186L,A265T)-JEV
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgccaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccucaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcaccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1713 - RNA, 2037 nt, Artificial Sequence
  derived and/or modified CDS sequence (opt2) from DENV-3 Consensus__SSopt-pr(D104A)MEdelstem_TM,(F108S,R186L,A265T)-JEV
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgccaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuccggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccucaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcaccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1714 - RNA, 2037 nt, Artificial Sequence
  derived and/or modified CDS sequence (opt2) from DENV-3 Consensus__SSopt-prMEdelstem_TM,(H259N)-JEV
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugaacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1715 - RNA, 2037 nt, Artificial Sequence
  derived and/or modified CDS sequence (opt2) from DENV-3 Consensus__SSopt-prMEdelstem_TM,(R186L,A265T)-JEV
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccucaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcaccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1716 - RNA, 2016 nt, Artificial Sequence
  derived and/or modified CDS sequence (opt2) from DENV-3 Consensus__SSopt-prMEdelstem_TM,del101-107,(R99P,F108N)-JEV
augaagcgcaagaagaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccccggcaacggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccuga

SEQ ID NO: 1717 - RNA, 3081 nt, Artificial Sequence
  derived and/or modified CDS sequence (opt2) from DENV-3 Consensus__SSc-prME-NS1
augaccucccucugccucaugaugauccuccccgccgcccucgccuuccaccucaccucccgcgacggcgagccccgcaugaucgucggcaagaacgagcgcggcaagucccuccucuucaagaccgccuccggcaucaacaugugcacccucaucgccauggaccucggcgagaugugcgacgacaccgucaccuacaagugcccccacaucaccgaggucgagcccgaggacaucgacugcuggugcaaccucaccuccaccugggucaccuacggcaccugcaaccaggccggcgagcaccgccgcgacaagcgcuccgucgcccucgccccccacgucggcaugggccucgacacccgcacccagaccuggauguccgccgagggcgccuggcgccaggucgagaaggucgagaccugggcccuccgccaccccggcuucaccauccucgcccucuuccucgcccacuacaucggcaccucccucacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccgucggcggcguccucaacucccucggcaagaugguccaccagaucuucggcuccgccuacaccgcccucuucuccggcgucuccugggucaugaagaucggcaucggcguccuccucaccuggaucggccucaacuccaagaacaccuccauguccuucuccugcaucgccaucggcaucaucacccucuaccucggcgccgucguccaggccgacaugggcugcgucaucaacuggaagggcaaggagcucaagugcggcuccggcaucuucgucaccaacgagguccacaccuggaccgagcaguacaaguuccaggccgacucccccaagcgccucgccaccgccaucgccggcgccugggagaacggcgucugcggcauccgcuccaccacccgcauggagaaccuccucuggaagcagaucgccaacgagcucaacuacauccucugggagaacaacaucaagcucaccgucgucgucggcgacaucaucggcguccucgagcagggcaagcgcacccucaccccccagcccauggagcucaaguacuccuggaagaccuggggcaaggccaagaucgucaccgccgagacccagaacuccuccuucaucaucgacggccccaacacccccgagugccccuccgucucccgcgccuggaacgucugggaggucgaggacuacggcuucggcgucuucaccaccaacaucuggcucaagcuccgcgaggucuacacccagcucugcgaccaccgccucauguccgccgccgucaaggacgagcgcgccguccacgccgacaugggcuacuggaucgagucccagaagaacggcuccuggaagcucgagaaggccucccucaucgaggucaagaccugcaccuggcccaagucccacacccucugguccaacggcguccucgaguccgacaugaucauccccaagucccucgccggccccaucucccagcacaaccaccgccccggcuaccacacccagaccgccggccccuggcaccucggcaagcucgagcucgacuucaacuacugcgagggcaccaccgucgucaucaccgagaacugcggcacccgcggccccucccuccgcaccaccaccgucuccggcaagcucauccacgaguggugcugccgcuccugcacccuccccccccuccgcuacaugggcgaggacggcugcugguacggcauggagauccgccccaucuccgagaaggaggagaacauggucaagucccucgucuccgccuga

SEQ ID NO: 1718 - RNA, 1824 nt, Artificial Sequence
  derived and/or modified CDS sequence (opt2) from DENV-3 Consensus__SSm-EdelTM-linker-ferritin
augacccagaaggucgucaucuucauccuccucaugcucgucacccccuccaugaccaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccuccggcggcgacaucaucaagcuccucaacgagcaggucaacaaggagaugcaguccuccaaccucuacauguccauguccuccuggugcuacacccacucccucgacggcgccggccucuuccucuucgaccacgccgccgaggaguacgagcacgccaagaagcucaucaucuuccucaacgagaacaacguccccguccagcucaccuccaucuccgcccccgagcacaaguucgagggccucacccagaucuuccagaaggccuacgagcacgagcagcacaucuccgaguccaucaacaacaucgucgaccacgccaucaaguccaaggaccacgccaccuucaacuuccuccagugguacgucgccgagcagcacgaggaggagguccucuucaaggacauccucgacaagaucgagcucaucggcaacgagaaccacggccucuaccucgccgaccaguacgucaagggcaucgccaagucccgcaaguccuga

SEQ ID NO: 1719 - RNA, 1821 nt, Artificial Sequence
  derived and/or modified CDS sequence (opt2) from DENV-3 Consensus__SStPA-WHbcAg-linker-EdelTM
auggacgccaugaagcgcggccucugcugcguccuccuccucugcggcgccgucuucgucgacuccgucaccggcauggacaucgaccccuacaaggaguucggcuccuccuaccagcuccucaacuuccucccccucgacuucuuccccgaccucaacgcccucgucgacaccgccaccgcccucuacgaggaggagcucaccggccgcgagcacugcuccccccaccacaccgccauccgccaggcccucgucugcugggacgagcucaccaagcucaucgccuggauguccuccaacaucaccuccgagcagguccgcaccaucaucgucaaccacgucaacgacaccuggggccucaagguccgccagucccucugguuccaccucuccugccucaccuucggccagcacaccguccaggaguuccucgucuccuucggcgucuggauccgcacccccgcccccuaccgcccccccaacgcccccauccucuccacccuccccgagcacaccgucaucugcggcggcggcggcuccggcggcggcggcaugcgcugcgucggcgucggcaaccgcgacuucgucgagggccucuccggcgccaccugggucgacgucguccucgagcacggcggcugcgucaccaccauggccaagaacaagcccacccucgacaucgagcuccagaagaccgaggccacccagcucgccacccuccgcaagcucugcaucgagggcaagaucaccaacaucaccaccgacucccgcugccccacccagggcgaggccacccuccccgaggagcaggaccagaacuacgucugcaagcacaccuacgucgaccgcggcuggggcaacggcugcggccucuucggcaagggcucccucgucaccugcgccaaguuccagugccucgagcccaucgagggcaaggucguccaguacgagaaccucaaguacaccgucaucaucaccguccacaccggcgaccagcaccaggucggcaacgagacccagggcgucaccgccgagaucaccccccaggccuccaccaccgaggccauccuccccgaguacggcacccucggccucgagugcuccccccgcaccggccucgacuucaacgagaugauccuccucaccaugaagaacaaggccuggaugguccaccgccagugguucuucgaccucccccuccccuggaccuccggcgccaccaccgagacccccaccuggaaccgcaaggagcuccucgucaccuucaagaacgcccacgccaagaagcaggaggucgucguccucggcucccaggagggcgccaugcacaccgcccucaccggcgccaccgagauccagaacuccggcggcaccuccaucuucgccggccaccucaagugccgccucaagauggacaagcucgagcucaagggcauguccuacgccaugugcaccaacaccuucguccucaagaaggaggucuccgagacccagcacggcaccauccucaucaaggucgaguacaagggcgaggacguccccugcaagauccccuucuccaccgaggacggccagggcaaggcccacaacggccgccucaucaccgccaaccccgucgucaccaagaaggaggagcccgucaacaucgaggccgagccccccuucggcgaguccaacaucgucaucggcaucggcgacaacgcccucaagaucaacugguacaagaagggcuccuccaucggcaagauguucgaggccaccgcccgcggcgcccgccgcauggccauccucggcgacaccgccugggacuucggcuccuga

SEQ ID NO: 1720 - RNA, 75 nt, Artificial Sequence
  derived and/or modified CDS sequence (opt3) from Homo sapiens__SigSeq(TPA)/SStPA
auggacgccaugaagagaggccugugcugugugcuccuucugugcggggcugucuucguugauagcgugaccgga

SEQ ID NO: 1721 - RNA, 489 nt, Artificial Sequence
  derived and/or modified CDS sequence (opt3) from Helicobacter pylori J99__Ferritin
gacaucauuaagcugcucaacgaacaggugaauaaagagaugcaaagcuccaaccuuuacaugucuaugucaaguuggugcuauacccacagccuggauggcgccggguuguucuuauuugaccaugcugcagaggaauacgagcacgccaagaaacugauaaucuuccuaaaugaaaacaauguccccguucagcucacauccauuucugcgccugagcauaaguuugagggacugacucagaucuuccagaaggcuuaugaacacgagcaacauauuucggaaucaaucaacaauauaguggaucacgccaucaaaagcaaggaccacgcaacguuuaacuuccuucagugguacguagccgagcagcaugaggaagaggugcuguuuaaagauauuuuggacaagaucgaacucauugguaaugagaaccacggccuguaucuggcugaucaguacgucaaagggaucgcaaagaguagaaaaucc

SEQ ID NO: 1722 - RNA, 450 nt, Artificial Sequence
  derived and/or modified CDS sequence (opt3) from Woodchuck hepatitis virus__WHbcAg
auggacaucgaucccuacaaggaguucggcagcuccuaucagcugcucaacuuucuuccucuggacuucuuuccagauuugaaugccuuaguggacaccgcuacagcacuguacgaagaggaacuaacugggagagagcacugcucuccgcaucacacggccauuaggcaagcgcucgucuguugggaugaacugaccaaacuuauagcuuggaugucaaguaacaucacaagcgagcagguucggacuauuaucgugaaucauguaaacgacaccuggggacugaaggugcgccaguccuugugguuccaccucucuugccugacauuuggucagcauaccguccaagaguuccuggugucguuuggcguuuggauucgaacucccgccccuuaucguccacccaaugcaccuauccucucaacauuaccagaacacaccgugauaugu

SEQ ID NO: 1723 - RNA, 303 nt, Artificial Sequence
  derived and/or modified CDS sequence (opt3) from Japanese encephalitis virus__Cterm-JEV/JEV
ggcagcacccuggggaaggccuucuccacaacucucaaaggagcucagagacuugcagcccugggugacacggcgugggauuuuggcucuaucgggggaguguucaacucaauuggcagggcuguccaccaaguuuuugguggggccuuccggaccuuguuuggaggcaugaguuggauaacacagggcuuaaugggggcacugcuacucuggaugggagugaaugcccgcgaccgaagcaucgcucuggcauuccuugccacugguggcguacugguguuuuuggcuaccaacguccaugcc

SEQ ID NO: 1724 - RNA, 15 nt, Artificial Sequence
  derived and/or modified CDS sequence (opt3) from Artificial__MKRKK
augaagagaaagaaa

SEQ ID NO: 1725 - RNA, 9 nt, Artificial Sequence
  derived and/or modified CDS sequence (opt3) from Artificial__Linker(SGG)
agcggcggg

SEQ ID NO: 1726 - RNA, 27 nt, Artificial Sequence
  derived and/or modified CDS sequence (opt3) from Artificial__Linker(G4SG4)
ggcgggggagguagcggcgggggaggc

SEQ ID NO: 1727 - RNA, 51 nt, Artificial Sequence
  derived and/or modified CDS sequence (opt3) from Foot-and-mouth disease virus__F2A/P2A
aacuucgaccuucucaagcuggccggcgauguggagagcaaucccgggccu

SEQ ID NO: 1728 - RNA, 300 nt, Artificial Sequence
  derived and/or modified CDS sequence (opt3) from DENV-1 CYD23__C
augaacaaucagagaaagaaaaccgccaggcccagcuucaacaugcugaagcgggcucgcaaucgaguguccacagucucucaacucgcaaaacguuuuucaaagggccuucugagugggcagggaccuaugaaauugguuauggccuucaucgcguuuuuaagauuccuggcuauuccaccgacugccgguauacuagcaagguggggcagcuuuaagaagaacggggccaucaaagugcuccggggauucaagaaagagauuuccaauaugcugaacaucaugaaucgcagaaggaag

SEQ ID NO: 1729 - RNA, 342 nt, Artificial Sequence
  derived and/or modified CDS sequence (opt3) from DENV-1 CYD23__C-SSc
augaacaaucagagaaagaaaaccgccaggcccagcuucaacaugcugaagcgggcucgcaaucgaguguccacagucucucaacucgcaaaacguuuuucaaagggccuucugagugggcagggaccuaugaaauugguuauggccuucaucgcguuuuuaagauuccuggcuauuccaccgacugccgguauacuagcaagguggggcagcuuuaagaagaacggggccaucaaagugcuccggggauucaagaaagagauuuccaauaugcugaacaucaugaaucgcagaaggaagucuguaacgaugcuucugauguugaugcccaccgcucucgca

SEQ ID NO: 1730 - RNA, 273 nt, Artificial Sequence
  derived and/or modified CDS sequence (opt3) from DENV-1 CYD23__pr
uuccaccugaccacaagaggcggggagccccauaugaucgugagcaagcaggaaaggggaaaaucccuccuuuuuaagacuucugccggugucaacaugugcacgcugauugcuauggacuugggcgaguuaugugaagauaccaugacauacaaaugcccucggauaacugaggcagaaccagacgauguugacuguuggugcaaugccaccgauacaugggugaccuaugggacuuguucacaaacaggagagcaccgccgagacaagcgu

SEQ ID NO: 1731 - RNA, 225 nt, Artificial Sequence
  derived and/or modified CDS sequence (opt3) from DENV-1 CYD23__M
agcguggcccuggcuccccacgucggccucgggcuugagaccagaacagaaacuuggauguccucugagggagcauggaagcagauccaaaggguugaaacgugggcccugcggcauccugguuucaccgugauugcguuguuuuuagcucacgccauaggcacaucaaucacucagaaagggauuaucuucauucugcuaaugcucguaaccccaaguauggca

SEQ ID NO: 1732 - RNA, 498 nt, Artificial Sequence
  derived and/or modified CDS sequence (opt3) from DENV-1 CYD23__prM
uuccaccugaccacaagaggcggggagccccauaugaucgugagcaagcaggaaaggggaaaaucccuccuuuuuaagacuucugccggugucaacaugugcacgcugauugcuauggacuugggcgaguuaugugaagauaccaugacauacaaaugcccucggauaacugaggcagaaccagacgauguugacuguuggugcaaugccaccgauacaugggugaccuaugggacuuguucacaaacaggagagcaccgccgagacaagcguaguguagcgcuggcuccgcaugugggccuaggucucgagaccagaacggaaacuuggaugagcuccgagggggccuggaaacagauccagagggucgaaaccugggcacugcggcaccccggauucacagugauugcccuuuuucuggcucaugcaaucggcacuucuauuacccagaagggcaucauauucaucuugcucaugcugguuacaccuucgauggcc

SEQ ID NO: 1733 - RNA, 1485 nt, Artificial Sequence
  derived and/or modified CDS sequence (opt3) from DENV-1 CYD23__E
augagaugcgugggcaucgggagcagggacuucgucgagggacuguccggugccaccuggguugaugugguacucgaacacggcucuugugugacaacuauggcuaaggacaaacccacgcuugauauugagcuguugaagaccgaagucacaaacccugcaguguuacggaaacugugcauagaggccaagaucucaaauacuaccacagacagucgcuguccaacccagggggaagcgacucuaguugaggagcaagaugcuaacuuugugugccgacguacauucgucgacagaggauggggcaaugguugugggcucuuuggaaaaggcagccugauuaccugcgccaaguucaagugugugacgaaacuugaaggcaagaucguacaguacgagaaccugaaauauuccguuauugugacuguccauaccggggaucagcaccaggugggaaaugaaucuacagagcaugguacuaccgcaacaaucaccccgcaagcccccacgacugagauacaguugacagacuacggcgcucucacccuggauugcucgccuaggacugggcuggacuuuaacgaaauggugcucuuaacaaugaaggagaaaucauggcugguccacaagcagugguuccuugauuugccacugcccuggaccagcggagcaaguacgucccaggaaaccuggaaucggcaagaccuacucguuacauuuaagacugcccaugcuaaaaagcaggaggugguagugcugggcucucaggaaggugccaugcacaccgcgcuuacaggggcaacugagauccagaccagcggaacaaccacuauuuucgccggccaccugaaaugucgcuugaagauggauaaacucacgcugaagggcauguccuaugucaugugcacagggucauuuaaauuagagaaggaaguggcugagacccaacauggaacuguucuggugcagaucaaguacgaagguaccgacgccccuuguaaaauuccauucaguacacaggacgagaagggcgucacccaaaacgggagacucaucacugcaaaucccauagugacagauaaagaaaagccuguaaacauugaggcugagccaccguuuggagaaagcuauaucguuauuggcgccggugagaaagcgcuuaagcugucuugguucaagaaaggguccucaaucggcaagauguuugaagccacggcaaggggagcucggcgcauggccaucuugggcgacaccgcuugggauuucgggagcauuggagguguguucacaagugucggcaagcuagugcaccagauauuugggacugccuacggaguccuguucucuggcguguccuggaccaugaaaaucgguauugggguucuccugacauggcuuggccugaauagccgaucgacuucuuuguccaugaccugcaucgcagugggacucguaacgcuguauuuaggcgucauggugcaggcc

SEQ ID NO: 1734 - RNA, 1983 nt, Artificial Sequence
  derived and/or modified CDS sequence (opt3) from DENV-1 CYD23__prME
uuccaccugaccacaagaggcggggagccccauaugaucgugagcaagcaggaaaggggaaaaucccuccuuuuuaagacuucugccggugucaacaugugcacgcugauugcuauggacuugggcgaguuaugugaagauaccaugacauacaaaugcccucggauaacugaggcagaaccagacgauguugacuguuggugcaaugccaccgauacaugggugaccuaugggacuuguucacaaacaggagagcaccgccgagacaagcguaguguagcgcuggcuccgcaugugggccuaggucucgagaccagaacggaaacuuggaugagcuccgagggggccuggaaacagauccagagggucgaaaccugggcacugcggcaccccggauucacagugauugcccuuuuucuggcucaugcaaucggcacuucuauuacccagaagggcaucauauucaucuugcucaugcugguuacaccuucgauggccaugcgcugcguggggauuggaucaagagauuuugucgagggucugagcggcgcuaccuggguggacguaguucucgagcacgggaguugugugacgacuauggccaaggauaaaccaacauuagacaucgaacugcuuaagaccgaggucacuaaccccgcgguguugaggaaacugugcauugaagcaaagaucuccaauacaaccacggauucucgguguccuacccaaggagaggccacucuaguggaggaacaggacgcuaacuucgucugccgccgaacauuuguugauagaggcugggguaauggguguggacucuucggcaaaggcagccugauaaccugcgccaaguuuaagugcgugacaaaacuugaggggaagauuguacaguacgaaaaccugaaauauuccgugaucgucacugugcacaccggagaccagcaucaaguugguaaugagucaacagaacacggcaccacugcaacgauuacaccacaggcucccaccacugagauccaguugaccgacuacggggcccucacacuggauuguaguccuaggaccggauuagacuucaacgaaauggugcugcucacuaugaaggagaaaagcuggcuuguccauaagcagugguuucuggauuugccacuaccguggacaucuggcgcguccacgucacaagagaccuggaaucggcaggaccugcucgugacuuucaaaacagcccacgcaaagaagcaggaaguaguugugcuggguagccaagagggggcuaugcacaccgcccuuacaggcgcuacugaaauccagaccaguggaacgaccacaauuuuugccggccaucugaaaugccguuugaagauggauaaacucacucugaaggggaugucuuaugucauguguaccggauccuucaaauuagagaaggaaguggcagagacacagcacgguacuguccuggugcagauaaaguacgagggcaccgacgcccccugcaaaaucccuuucagcacgcaagaugaaaaggggguuacacagaacggacgccuaauuaccgcuaauccaaucgugacugacaaagagaagcccguaaacauagaagcggagccuccauuuggcgagucguauauugucaucggugcaggggaaaaagcccucaagcugucuugguucaagaaaggcuccucaaucggaaagauguuugaggcuacagccagaggcgcaaggcggauggccauucuuggggauaccgcuugggacuucggaaguaucgguggcguguuuacuagcguugggaaauuggugcaucagauuuucggaaccgccuacggcguccuguuuuccggugugucuuggacaaugaagauagggaucggcguacuccugacguggcuuggacugaauagccgaucaaccaguuuguccaugacuuguauugcagugggccucguuacacuguacuuaggggucauggugcaggcg

SEQ ID NO: 1735 - RNA, 2025 nt, Artificial Sequence
  derived and/or modified CDS sequence (opt3) from DENV-1 CYD23__SSc-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcaggaguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaggaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggcc

SEQ ID NO: 1736 - RNA, 2325 nt, Artificial Sequence
  derived and/or modified CDS sequence (opt3) from DENV-1 CYD23__C-prME
augaacaaucagagaaagaaaaccgccaggcccagcuucaacaugcugaagcgggcucgcaaucgaguguccacagucucucaacucgcaaaacguuuuucaaagggccuucugagugggcagggaccuaugaaauugguuauggccuucaucgcguuuuuaagauuccuggcuauuccaccgacugccgguauacuagcaagguggggcagcuuuaagaagaacggggccaucaaagugcuccggggauucaagaaagagauuuccaauaugcugaacaucaugaaucgcagaaggaagucuguaacgaugcuucugauguugaugcccaccgcucucgcauuucaccugacaacucggggcggugaaccucauaugauugugucgaaacaggagcgcgggaagucacuucucuucaagaccagcgccggagucaacaugugcacauuaaucgcuauggaccugggcgaacuuugugaggauaccaugacuuacaaaugcccacgaauaacagaagccgagcccgacgauguggacuguuggugcaaugcgaccgauacguggguuacuuauggcaccuguagucagacaggggagcacagaagggacaagcgguccguggcauuggccccucaugucggacugggucuagaaacucguaccgagacauggaugucuagcgaaggcgcuuggaaacaaauccagcgcguggagaccugggcccucagacacccaggguuuacgguaauugcacuguuccuugcucaugccaucggaacuuccauuacacagaagggcaucauauuuauucuguugaugcucguuacccccucaauggcgaugaggugcguggguaucgggagucgggauuucgucgagggacugagcggcgccacuuggguggacguggucuuagaacacggcucuuguguuacaaccauggcaaaagauaagccuacgcuggacauugagcuccuuaaaaccgaagugacaaacccagcuguacugcgaaaguugugcaucgaggccaagaucuccaauacuaccacagauucacgcuguccgacucagggggaagcuacccuaguggaggagcaagacgccaacuuugucugcagaaggacauucguggaucggggaugggguaauggcugugggcuguucggaaaaggcagccucauuaccugcgcaaaguuuaaaugcguuacuaagcuggaagguaaaauagugcaguacgagaaccuuaaguauagugucaucgugacgguacacacaggggaccagcaucagguuggcaaugaaucuaccgagcacggaacuaccgccacaauuacuccccaagcuccuaccacagaaauccagcugacggacuacggcgcguugacccucgauuguuccccacgcacugggcuggacuucaacgagaugguguuacugacaaugaaggagaaaagcuggcuaguccauaagcagugguuucucgaucugccccuuccuuggaccucgggagcaucuacaucccaagaaacuuggaacagacaggacuugcuggugaccuucaaaacggcccacgcuaagaaacaggaggucgugguucucgguucacaggaaggcgccaugcacaccgcacugacaggggccacugagauacaaaccaguggaacaacuaccauuuuugcuggccaucuuaagugcaggcugaagauggauaaauugacgcucaaggguaugagcuaugugauguguacaggguccuucaaacuggaaaaggagguagccgagacccagcacggcacugucuuagugcagaucaaauacgaaggaacagacgcaccaugcaagauccccuuuucuacccaggaugagaagggcguuacucaaaaugggcgucugauuaccgcgaacccgaucgugacagacaaagaaaagccugucaauauugaggcugagcccccauucggagaaagcuauauagugaucggugccggcgagaaagcacuaaagcucucaugguuuaaaaaggggaguuccauuggaaaaauguucgaagccacggcucggggcgcccgaagaauggcaauccugggugauaccgcuugggacuuugggagcaucggcggaguauucacuucugugggcaagcugguucaucagauuuuugggacagccuacggagucuuguucucaggcgugaguuggaccaugaagauagguaucggggugcugcucacauggcugggauuaaacagcagguccacuucucugucgaugaccuguauugcggucggccuuguuacguuguaccucggugugauggugcaggcc

SEQ ID NO: 1737 - RNA, 45 nt, Artificial Sequence
  derived and/or modified CDS sequence (opt3) from DENV-1 CYD23__SSc
augagcgugaccaugcugcucaugcuuaugcccacagcccuggcu

SEQ ID NO: 1738 - RNA, 57 nt, Artificial Sequence
  derived and/or modified CDS sequence (opt3) from DENV-1 CYD23__SSopt
augaagagaaagaaaagcgugaccaugcugcucaugcuuaugcccacagcccuggcu

SEQ ID NO: 1739 - RNA, 57 nt, Artificial Sequence
  derived and/or modified CDS sequence (opt3) from DENV-1 CYD23__SSm
augacccagaagggcaucauuuucauacugcucaugcuugugacacccagcauggcc

SEQ ID NO: 1740 - RNA, 1488 nt, Artificial Sequence
  derived and/or modified CDS sequence (opt3) from DENV-1 CYD23__E
augagaugcgugggcaucgggagcagggacuucgucgagggacuguccggugccaccuggguugaugugguacucgaacacggcucuugugugacaacuauggcuaaggacaaacccacgcuugauauugagcuguugaagaccgaagucacaaacccugcaguguuacggaaacugugcauagaggccaagaucucaaauacuaccacagacagucgcuguccaacccagggggaagcgacucuaguugaggagcaagaugcuaacuuugugugccgacguacauucgucgacagaggauggggcaaugguugugggcucuuuggaaaaggcagccugauuaccugcgccaaguucaagugugugacgaaacuugaaggcaagaucguacaguacgagaaccugaaauauuccguuauugugacuguccauaccggggaucagcaccaggugggaaaugaaucuacagagcaugguacuaccgcaacaaucaccccgcaagcccccacgacugagauacaguugacagacuacggcgcucucacccuggauugcucgccuaggacugggcuggacuuuaacgaaauggugcucuuaacaaugaaggagaaaucauggcugguccacaagcagugguuccuugauuugccacugcccuggaccagcggagcaaguacgucccaggaaaccuggaaucggcaagaccuacucguuacauuuaagacugcccaugcuaaaaagcaggaggugguagugcugggcucucaggaaggugccaugcacaccgcgcuuacaggggcaacugagauccagaccagcggaacaaccacuauuuucgccggccaccugaaaugucgcuugaagauggauaaacucacgcugaagggcauguccuaugucaugugcacagggucauuuaaauuagagaaggaaguggcugagacccaacauggaacuguucuggugcagaucaaguacgaagguaccgacgccccuuguaaaauuccauucaguacacaggacgagaagggcgucacccaaaacgggagacucaucacugcaaaucccauagugacagauaaagaaaagccuguaaacauugaggcugagccaccguuuggagaaagcuauaucguuauuggcgccggugagaaagcgcuuaagcugucuugguucaagaaaggguccucaaucggcaagauguuugaagccacggcaaggggagcucggcgcauggccaucuugggcgacaccgcuugggauuucgggagcauuggagguguguucacaagugucggcaagcuagugcaccagauauuugggacugccuacggaguccuguucucuggcguguccuggaccaugaaaaucgguauugggguucuccugacauggcuuggccugaauagccgaucgacuucuuuguccaugaccugcaucgcagugggacucguaacgcuguauuuaggcgucauggugcaggccuga

SEQ ID NO: 1741 - RNA, 1182 nt, Artificial Sequence
  derived and/or modified CDS sequence (opt3) from DENV-1 CYD23__EdelTM-variant (aa1-394)
augagaugcgugggcaucgggagcagggacuucgucgagggacuguccggugccaccuggguugaugugguacucgaacacggcucuugugugacaacuauggcuaaggacaaacccacgcuugauauugagcuguugaagaccgaagucacaaacccugcaguguuacggaaacugugcauagaggccaagaucucaaauacuaccacagacagucgcuguccaacccagggggaagcgacucuaguugaggagcaagaugcuaacuuugugugccgacguacauucgucgacagaggauggggcaaugguugugggcucuuuggaaaaggcagccugauuaccugcgccaaguucaagugugugacgaaacuugaaggcaagaucguacaguacgagaaccugaaauauuccguuauugugacuguccauaccggggaucagcaccaggugggaaaugaaucuacagagcaugguacuaccgcaacaaucaccccgcaagcccccacgacugagauacaguugacagacuacggcgcucucacccuggauugcucgccuaggacugggcuggacuuuaacgaaauggugcucuuaacaaugaaggagaaaucauggcugguccacaagcagugguuccuugauuugccacugcccuggaccagcggagcaaguacgucccaggaaaccuggaaucggcaagaccuacucguuacauuuaagacugcccaugcuaaaaagcaggaggugguagugcugggcucucaggaaggugccaugcacaccgcgcuuacaggggcaacugagauccagaccagcggaacaaccacuauuuucgccggccaccugaaaugucgcuugaagauggauaaacucacgcugaagggcauguccuaugucaugugcacagggucauuuaaauuagagaaggaaguggcugagacccaacauggaacuguucuggugcagaucaaguacgaagguaccgacgccccuuguaaaauuccauucaguacacaggacgagaagggcgucacccaaaacgggagacucaucacugcaaaucccauagugacagauaaagaaaagccuguaaacauugaggcugagccaccguuuggagaaagcuauaucguuauuggcgccggugagaaagcgcuuaagcugucuugguucaagaaa

SEQ ID NO: 1742 - RNA, 1275 nt, Artificial Sequence
  derived and/or modified CDS sequence (opt3) from DENV-1 CYD23__EdelTM-variant (aa1-424)
augagaugcgugggcaucgggagcagggacuucgucgagggacuguccggugccaccuggguugaugugguacucgaacacggcucuugugugacaacuauggcuaaggacaaacccacgcuugauauugagcuguugaagaccgaagucacaaacccugcaguguuacggaaacugugcauagaggccaagaucucaaauacuaccacagacagucgcuguccaacccagggggaagcgacucuaguugaggagcaagaugcuaacuuugugugccgacguacauucgucgacagaggauggggcaaugguugugggcucuuuggaaaaggcagccugauuaccugcgccaaguucaagugugugacgaaacuugaaggcaagaucguacaguacgagaaccugaaauauuccguuauugugacuguccauaccggggaucagcaccaggugggaaaugaaucuacagagcaugguacuaccgcaacaaucaccccgcaagcccccacgacugagauacaguugacagacuacggcgcucucacccuggauugcucgccuaggacugggcuggacuuuaacgaaauggugcucuuaacaaugaaggagaaaucauggcugguccacaagcagugguuccuugauuugccacugcccuggaccagcggagcaaguacgucccaggaaaccuggaaucggcaagaccuacucguuacauuuaagacugcccaugcuaaaaagcaggaggugguagugcugggcucucaggaaggugccaugcacaccgcgcuuacaggggcaacugagauccagaccagcggaacaaccacuauuuucgccggccaccugaaaugucgcuugaagauggauaaacucacgcugaagggcauguccuaugucaugugcacagggucauuuaaauuagagaaggaaguggcugagacccaacauggaacuguucuggugcagaucaaguacgaagguaccgacgccccuuguaaaauuccauucaguacacaggacgagaagggcgucacccaaaacgggagacucaucacugcaaaucccauagugacagauaaagaaaagccuguaaacauugaggcugagccaccguuuggagaaagcuauaucguuauuggcgccggugagaaagcgcuuaagcugucuugguucaagaaaggguccucaaucggcaagauguuugaagccacggcaaggggagcucggcgcauggccaucuugggcgacaccgcuugggauuucgggagcuga

SEQ ID NO: 1743 - RNA, 1266 nt, Artificial Sequence
  derived and/or modified CDS sequence (opt3) from DENV-1 CYD23__EdelTM-variant (aa1-421)
augagaugcgugggcaucgggagcagggacuucgucgagggacuguccggugccaccuggguugaugugguacucgaacacggcucuugugugacaacuauggcuaaggacaaacccacgcuugauauugagcuguugaagaccgaagucacaaacccugcaguguuacggaaacugugcauagaggccaagaucucaaauacuaccacagacagucgcuguccaacccagggggaagcgacucuaguugaggagcaagaugcuaacuuugugugccgacguacauucgucgacagaggauggggcaaugguugugggcucuuuggaaaaggcagccugauuaccugcgccaaguucaagugugugacgaaacuugaaggcaagaucguacaguacgagaaccugaaauauuccguuauugugacuguccauaccggggaucagcaccaggugggaaaugaaucuacagagcaugguacuaccgcaacaaucaccccgcaagcccccacgacugagauacaguugacagacuacggcgcucucacccuggauugcucgccuaggacugggcuggacuuuaacgaaauggugcucuuaacaaugaaggagaaaucauggcugguccacaagcagugguuccuugauuugccacugcccuggaccagcggagcaaguacgucccaggaaaccuggaaucggcaagaccuacucguuacauuuaagacugcccaugcuaaaaagcaggaggugguagugcugggcucucaggaaggugccaugcacaccgcgcuuacaggggcaacugagauccagaccagcggaacaaccacuauuuucgccggccaccugaaaugucgcuugaagauggauaaacucacgcugaagggcauguccuaugucaugugcacagggucauuuaaauuagagaaggaaguggcugagacccaacauggaacuguucuggugcagaucaaguacgaagguaccgacgccccuuguaaaauuccauucaguacacaggacgagaagggcgucacccaaaacgggagacucaucacugcaaaucccauagugacagauaaagaaaagccuguaaacauugaggcugagccaccguuuggagaaagcuauaucguuauuggcgccggugagaaagcgcuuaagcugucuugguucaagaaaggguccucaaucggcaagauguuugaagccacggcaaggggagcucggcgcauggccaucuugggcgacaccgcuugggauuga

SEQ ID NO: 1744 - RNA, 2031 nt, Artificial Sequence
  derived and/or modified CDS sequence (opt3) from DENV-1 CYD23__SSc-prME
augagcgugaccaugcugcucaugcuuaugcccacagcccuggcuuuccacuugacuacgagaggcggggagccucauaugaucgucuccaagcaggaaaggggaaaaucuuuacuguuuaagaccucagcaggaguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaggaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccuga

SEQ ID NO: 1745 - RNA, 2031 nt, Artificial Sequence
  derived and/or modified CDS sequence (opt3) from DENV-1 CYD23__SSc-prME(F108S)
augagcgugaccaugcugcucaugcuuaugcccacagcccuggcuuuccacuugacuacgagaggcggggagccucauaugaucgucuccaagcaggaaaggggaaaaucuuuacuguuuaagaccucagccgguguuaacaugugcacacuaauugcaauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaggaacaggacgcaaacuucguuugccgccgaacauuuguggauagaggcugggguaauggguguggauuguccggcaaaggcucacucauaacuugcgcuaaguucaagugcguaaccaaacuggaggggaagauugugcaguacgaaaacuuaaaauauagugucaucgugacaguucacaccggagaccagcaucaaguggguaaugagagcacugaacacggcacgacagccaccauuacuccccaggcgccuaccacagagauccagcugaccgacuacggggcccucacucuugauuguucuccaaggacaggacuggacuuuaacgaaauggucuugcuaacgaugaaggagaaauccuggcuggugcauaagcagugguuccucgaucugccgcuucccuggaccucaggcgcaagcacaagucaagagacuuggaaucggcaggaccuguugguaaccuuuaaaacagcucacgccaagaagcaggaaguugugguccucgguucucaagagggggcuaugcacacugcccugaccggcgcaacggaaauccagaccuccggaacaacuaccauuuucgccggccauuuaaaaugccgucugaagauggauaaacuaacacucaaggggaugagcuaugugauguguacuggaucguuuaaacuggagaaggaagucgcugagacccagcacgguacggugcuuguucagauaaaguacgagggcacagacgcgccuugcaaaaucccauucucuacccaagaugaaaagggggugacucagaacggacgcuugauuacagcaaaucccaucguaaccgacaaagagaagccugucaacauagaagccgagccacccuucggcgaguccuauauugugaucggugcuggggaaaaagcccugaagcucucaugguuuaagaaaggcaguagcaucggaaagauguucgaggcaacugccagaggcgcuaggcggauggccauucugggggauaccgcaugggacuuuggauccaucgguggcguuuucacaucuguggggaaacuuguccaucagauuuuuggaacggcguacggcgugcuguucagcgguguaucauggaccaugaagauagggaucggcguguugcucacuuggcugggauuaaauagucgauccacaagccugucuaugaccuguauugcuguuggccuagucacacucuaccugggggugauggugcaggccuga

SEQ ID NO: 1746 - RNA, 2031 nt, Artificial Sequence
  derived and/or modified CDS sequence (opt3) from DENV-1 CYD23__SSc-prMEdelstem_TM-JEV
augagcgugaccaugcugcucaugcuuaugcccacagcccuggcuuuccacuugacuacgagaggcggggagccucauaugaucgucuccaagcaggaaaggggaaaaucuuuacuguuuaagaccucagcaggaguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaggaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaacucugggaaaggcauuuaguaccacacuuaaaggcgcccagagacuggcugccuugggggauacggcaugggacuucggaagcaucgguggcguuuuuaauuccauugggagggcggugcaucaggucuucggaggcgcuuuucggacccucuucggugggaugucuuggaucacucaaggccugaugggagccuuacugcuauggaugggcgugaacgcacgagaucgcagcauugcccucgcuuuucuggccacagggggaguacuuguguucuuggcaaccaauguucacgcuuga

SEQ ID NO: 1747 - RNA, 2379 nt, Artificial Sequence
  derived and/or modified CDS sequence (opt3) from DENV-1 CYD23__C-P2A-SSc-prME
augaacaaucagagaaagaaaaccgccaggcccagcuucaacaugcugaagcgggcucgcaaucgaguguccacagucucucaacucgcaaaacguuuuucaaagggccuucugagugggcagggaccuaugaaauugguuauggccuucaucgcguuuuuaagauuccuggcuauuccaccgacugccgguauacuagcaagguggggcagcuuuaagaagaacggggccaucaaagugcuccggggauucaagaaagagauuuccaauaugcugaacaucaugaaucgcagaaggaagaacuuugaccuucugaaauuggcuggcgauguagaaucuaaucccgguccuucggugacgaugcuccugaugcugaugccaaccgcacucgccuuccacuuaacaacucgcgggggagagccccauaugauugucucaaagcaggaacggggcaagagccugcuuuuuaaaaccagugcuggcgugaacaugugcacauugaucgccauggaccugggggagcuaugugaagauaccaugacuuacaagugcccucgaauaacagaggcggagccagacgauguugacuguuggugcaaugcaaccgauacgugggugacuuauggaaccuguucccagacaggugaacacagaagggacaaacggucugucgcccucgcuccccaugugggccuggggcuugagacucguaccgaaacauggaugagcuccgagggagccuggaagcaaauccagcgcguagagaccugggcacugagacacccuggcuucacgguuauugcuuuguuucucgcccaugcgaucgguacuucaauuacacagaaagggaucauauucauucuguuaaugcuggugaccccaaguauggccaugaggugcgucggaaucggcagccgggauuuuguggaaggccucucuggggcaacuuggguggacgucguucuugagcacggauccugugugacaaccauggcuaaggauaaaccgacgcuggacauugaauugcuaaagaccgagguaacaaaccccgccgugcugcgaaagcucugcaucgaagcuaaaaucucaaauacuaccacagauagccgcuguccuacucagggugaggccacccuggucgaggaacaagacgcaaacuucgugugcagaaggacauucguugaccggggcugggggaauggauguggccuuuuugguaaggggagucuguugaccugcgccaaauucaagugcgugacuaaacucgagggcaagauuguccaguacgaaaaccugaaguauucugugauaguaacgguucacacaggagaucagcaucaggugggcaacgaguccaccgaacacgggacuaccgcuacaaucaccccacaagcgcccacuacagagauucaguuaacggacuacggagcacugacccuagauuguagcccucgcacuggucucgacuuuaaugagaugguccugcuuacaaugaaagaaaagucgugguuggugcauaaacagugguuccuggaucucccacugcccuggaccucuggcgccuccacaucacaagagacuuggaacagacaggaccuucuggucaccuuuaagacggcucacgccaaaaagcaggaagugguuguguuggggagucaggagggagcaaugcacaccgcccucacaggcgcuacugaaauccaaaccagcgguacaacuaccauauucgccgggcaucugaagugcagguuaaaaauggauaagcugacgcuaaaaggcauguccuauguaauguguacaggaucuuuuaagcucgagaaagaggucgcagaaacccagcacggcacugugcugguucagauuaaguacgaggggacagacgcgccgugcaagaucccuuucagcacccaggaugaaaaaggagugacucaaaauggucgucuuaucaccgcuaaccccauugucacagacaaggagaaaccagugaauaucgaggccgaaccucccuuuggcgagucauauauuguaauaggggcaggagaaaaggccuugaaacugaguugguucaagaaaggcuccagcaucgguaagauguuugaggcuacggcccgaggggcacggagaauggcuauucucggcgauaccgccugggacuucggaucuaucggcgggguguuuacuucaguuggaaagcugguccaucagaucuucggcacagcguacgguguguuauucaguggggugagcuggaccaugaaaauuggaauaggcguccugcuuacaugguugggucucaacuccaggucuacuucgcugagcaugaccuguaucgccguuggccuagugacgcuguaccucggggugaugguacaggcuuga

SEQ ID NO: 1748 - RNA, 2043 nt, Artificial Sequence
  derived and/or modified CDS sequence (opt3) from DENV-1 CYD23__SSopt-prME(F108S)
augaagagaaagaaaagcgugaccaugcugcucaugcuuaugcccacagcccuggcuuuccacuugacuacgaggggcggggagccucauaugaucgucuccaagcaggaacggggaaagucuuuacuguuuaaaaccucagccgguguuaacaugugcacacuaauugcaauggaccucggcgagcugugugaagauacuaugaccuacaagugcccacgcauaacagaggcggaaccggacgauguggacuguuggugcaaugcuaccgauacuuggguaacauaugggaccuguagucaaacgggagagcaccgacgugacaagagaagcguggcccuugcaccccaugucggccuggguuuggagacuaggaccgaaacauggauguccucugagggggccuggaaacagauccagcggguggaaacuugggcucuccgccacccuggauucaccguuauugcacuguuucuggcccaugcuaucggcacaucgauuacccagaagggcaucauauucauccucuuaaugcuggugacgccaucaauggccaugagaugcgucgggauuggaagcagggauuuuguggagggucuuaguggcgcgacuuggguagacguuguguuggagcacggguccugugucacaaccauggcaaaagauaagcccacucuggacaucgaacuacucaaaacagaggugaccaacccugccgugcugcggaaacuuugcauugaagcuaagaucucuaauacgaccacagauagccgcuguccaacucaaggagaggccacccuggucgaggaacaggacgcaaacuucguuugccgaagaacauuuguggauaggggcugggguaauggguguggauuguccggcaagggcucacucauaacuugcgcuaaguucaaaugcguaaccaagcuggaggggaaaauugugcaguacgaaaacuuaaaguauagugucaucgugacaguucacaccggagaccagcaucaaguggguaaugagagcacugaacacggcacgacagccaccauuacuccccaggcgccuaccacagagauccagcugaccgacuacggggcccucacucuugauuguucuccacggacaggacuggacuuuaacgaaauggucuugcuaacgaugaaagagaaguccuggcuggugcauaagcagugguuccucgaucugccgcuucccuggaccucaggcgcaagcacaagucaagagacuuggaaucgucaggaccuguugguaaccuuuaaaacagcucacgccaagaaacaggaaguugugguccucgguucucaagagggggcuaugcacacugcccugaccggcgcaacggaaauccagaccuccggaacaacuaccauuuucgccggccauuuaaagugccgccugaaaauggauaagcuaacacucaaggggaugagcuaugugauguguacuggaucguuuaaacuggagaaggaagucgcugagacccagcacgguacggugcuuguucagauaaaauacgagggcacagacgcgccuugcaagaucccauucucuacccaagaugaaaaaggggugacucagaacggaagauugauuacagcaaaucccaucguaaccgacaaggagaagccugucaacauagaagccgagccacccuucggcgaguccuauauugugaucggugcuggggaaaaagcccugaagcucucaugguuuaaaaagggcaguagcaucggaaaaauguucgaggcaacugccaggggcgcucggcgaauggccauucugggggauaccgcaugggacuuuggauccaucgguggcguuuucacaucuguggggaaacuuguccaucagauuuuuggaacggcguacggcgugcuguucagcgguguaucauggaccaugaagauagggaucggcguguugcucacuuggcugggauuaaauagucgcuccacaagccugucuaugaccuguauugcuguuggccuagucacacucuaccugggggugauggugcaggccuga

SEQ ID NO: 1749 - RNA, 2043 nt, Artificial Sequence
  derived and/or modified CDS sequence (opt3) from DENV-1 CYD23__SSopt-prME(F96H)
augaagagaaagaaaagcgugaccaugcugcucaugcuuaugcccacagcccuggcuuuccacuugacuacgaggggcggggagccucauaugaucgucuccaagcaggaacggggaaagucuuuacuguuuaaaaccucagcaggaguuaacaugugcacacuaauugccauggaccucggcgagcugugugaagauacuaugaccuacaagugcccacgcauaacagaggcggaaccggacgauguggacuguuggugcaaugcuaccgauacuuggguaacauaugggaccuguagucaaacgggagagcaccgacgugacaagagaagcguggcccuugcaccccaugucggccuggguuuggagacuaggaccgaaacauggauguccucugagggggccuggaaacagauccagcggguggaaacuugggcucuccgccacccuggauucaccguuauugcacuguuucuggcccaugcuaucggcacaucgauuacccagaagggcaucauauucauccucuuaaugcuggugacgccaucaauggccaugagaugcgucgggauuggaagcagggauuuuguggagggucuuaguggcgcgacuuggguagacguuguguuggagcacggguccugugucacaaccauggcaaaagauaagcccacucuggacaucgaacuacucaaaacagaggugaccaacccugccgugcugcggaaacuuugcauugaagcuaagaucucuaauacgaccacagauagccgcuguccaacucaaggagaggccacccuggucgaggaacaggacgcaaacuucguuugccgaagaacacacguggauaggggcugggguaauggguguggauuguuuggcaagggcucccucauaacuugcgcuaaguucaaaugcguaaccaagcuggaggggaaaauugugcaguacgaaaacuuaaaguauucagucaucgugacaguucauaccggagaccagcaccaaguggguaaugagaguacugaacauggcacgacagccaccauuacuccccaggcgccuaccacagagauccagcugaccgacuacggggcccucacucuugauuguagcccacggacaggacuggacuuuaacgaaauggucuugcuaacgaugaaagagaagucuuggcuggugcacaagcagugguuccucgaucugccgcuucccuggaccuccggcgcaucaacuagccaagagacauggaaucgucaggaccuguugguaaccuuuaaaacagcucacgccaagaaacaggaaguugugguccucgguagucaagagggggcuaugcauacugcccugaccggcgcaacggaaauccagaccucuggaacaacuaccauuuucgccggccacuuaaagugccgccugaaaauggauaagcuaacacucaaggggauguccuaugugauguguacugguagcuuuaaacuggagaaggaagucgcugagacccagcaugguacggugcuuguucagauaaaauacgagggcacagacgcgccuugcaagaucccauucucgacccaagaugaaaaaggggugacucagaacggaagauugauuacagcaaaucccaucguaaccgacaaggagaagccugucaacauagaagccgagccacccuucggcgagucuuauauugugaucggugcuggggaaaaagcccugaagcucuccugguuuaaaaagggcucaaguaucggaaaaauguucgaggcaacugccaggggcgcucggcgaauggccauucugggggauaccgcaugggacuuuggaagcaucgguggcguuuucacauccguggggaaacuuguccaccagauuuuuggaacggcguacggcgugcuguucucugguguaagcuggaccaugaagauagggaucggcguguugcucacuuggcugggauuaaauucacgcaguacaucccugagcaugaccuguauugcuguuggccuagucacacucuaccugggggugauggugcaggccuga

SEQ ID NO: 1750 - RNA, 2043 nt, Artificial Sequence
  derived and/or modified CDS sequence (opt3) from DENV-1 CYD23__SSopt-prME(S186F)
augaagagaaagaaaagcgugaccaugcugcucaugcuuaugcccacagcccuggcuuuccacuugacuacgaggggcggggagccucauaugaucgucuccaagcaggaacggggaaagucuuuacuguuuaaaaccucagccgguguuaacaugugcacacuaauugcaauggaccucggcgagcugugugaagauacuaugaccuacaagugcccacgcauaacagaggcggaaccggacgauguggacuguuggugcaaugcuaccgauacuuggguaacauaugggaccuguagucaaacgggagagcaccgacgugacaagagaagcguggcccuugcaccccaugucggccuggguuuggagacuaggaccgaaacauggauguccucugagggggccuggaaacagauccagcggguggaaacuugggcucuccgccacccuggauucaccguuauugcacuguuucuggcccaugcuaucggcacaucgauuacccagaagggcaucauauucauccucuuaaugcuggugacgccaucaauggccaugagaugcgucgggauuggaagcagggauuuuguggagggucuuaguggcgcgacuuggguagacguuguguuggagcacggguccugugucacaaccauggcaaaagauaagcccacucuggacaucgaacuacucaaaacagaggugaccaacccugccgugcugcggaaacuuugcauugaagcuaagaucucuaauacgaccacagauagccgcuguccaacucaaggagaggccacccuggucgaggagcaggacgcaaacuucguuugccgaagaacauuuguggauaggggcugggguaauggguguggauuguucggcaagggcucccucauaacuugcgcuaaguuuaaaugcguaaccaagcuggaggggaaaauugugcaguacgaaaacuuaaaguauucagucaucgugacaguucacaccggagaccagcaucaaguggguaaugagaguacugaacacggcacgacagccaccauuacuccccaggcgccuaccacagagauccagcugaccgacuacggggcccucacucuugauuguuucccacggacaggacuggacuuuaacgaaauggucuugcuaacgaugaaagaaaagagcuggcuggugcauaagcagugguuccucgaucugccgcuucccuggaccucuggcgcauccacuucacaagagacauggaaucgucaggaccuguugguaaccuuuaaaacagcucacgccaagaaacaggaaguugugguccucgguagccaagagggggcuaugcacacugcccugaccggcgcaacggaaauccagaccaguggaacaacuaccauuuucgccggccauuuaaagugccgccugaaaauggauaagcuaacacucaaggggaugucuuaugugauguguacuggauccuucaaacuggagaaggaagucgcugagacccagcacgguacggugcuuguucagauaaaauacgagggcacagacgcgccuugcaagaucccauuuagcacccaagaugaaaaaggggugacucagaacggaagauugauuacagcaaaucccaucguaaccgacaaggagaagccugucaacauagaagccgagccacccuucggcgagucguauauugugaucggugcuggggaaaaagcccugaagcucucuugguuuaaaaagggcuccucaaucggaaaaauguucgaggcaacugccaggggcgcucggcgaauggccauucugggggauaccgcaugggacuuuggaaguaucgguggcguuuucacaagcguggggaaacuuguccaucagauuuuuggaacggcguacggcgugcuguucuccgguguaucuuggaccaugaagauagggaucggcguguugcucacuuggcugggauuaaauagccgcucaacaagucuguccaugaccuguauugcuguuggccuagucacacucuaccugggggugauggugcaggccuga

SEQ ID NO: 1751 - RNA, 2043 nt, Artificial Sequence
  derived and/or modified CDS sequence (opt3) from DENV-1 CYD23__SSopt-prME(R188L)
augaagaggaaaaagagcgugaccaugcugcucaugcuuaugcccacagcccuggcuuuccacuugacuacgagaggcggggagccucauaugaucgucuccaaacaggaacggggaaagucuuuacuguuuaaaaccucagcaggaguuaacaugugcacacuaauugccauggaccucggcgagcugugugaagauacuaugaccuacaagugcccacgcauaacagaggcggaaccggacgauguggacuguuggugcaaugcuaccgauacuuggguaacauaugggaccuguagucaaacgggagagcaccgacgugacaagagaagcguggcccuugcaccccaugucggccuggguuuggagacuaggaccgaaacauggauguccucugagggggccuggaaacagauccagcggguggaaacuugggcucuccgccacccuggauucaccguuauugcacuguuucuggcccaugcuaucggcacaucgauuacccagaagggcaucauauucauccucuuaaugcuggugacgccaucaauggccaugagaugcgucgggauuggaagcagggauuuuguggagggucuuaguggcgcgacuuggguagacguuguguuggagcacggguccugugucacaaccauggcaaaagauaagcccacucuggacaucgaacuacucaaaacagaggugaccaacccugccgugcugcggaagcugugcauugaagcuaagaucucuaauacgaccacagauagccgcuguccaacucaaggagaggccacccuggucgaggaacaggacgcaaacuucguuugccgaagaacauuuguggauaggggcugggguaauggguguggauuguucggcaaaggcucccucauaacuugcgcuaaguuuaaaugcguaaccaagcuggaggggaaaauugugcaguacgaaaacuuaaaguauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccacugacaggauuggacuucaacgaaaugguccuacugacgaugaaagagaagucuuggcucgugcauaagcagugguuucuggaucuuccgcugcccuggaccuccggcgcaucaacuagccaagagacauggaaucggcaggacuugcucguaaccuucaaaacagcucacgccaagaaacaggaaguugugguccuggguagucaagagggggcuaugcacacugccuuaaccggcgcaacggaaauccagaccucuggaacaacuaccauuuuugccggccaucugaagugccgucuaaaaauggauaagcucacacugaaggggauguccuaugugauguguacugguagcuucaaacuugagaaggaagucgcugagacccagcacgguacgguguugguucagauaaaauacgagggcacagacgcgccuugcaagaucccauucucgacccaagaugaaaaaggggugacucagaacggacgccugauuacagcaaaucccaucguaaccgacaaggagaagccugucaacauagaagccgagccacccuuuggcgagucuuauauugugaucggugcuggggaaaaagcccucaagcuguccugguucaaaaagggcucaaguaucggaaaaauguuugaggcaacugccagaggcgcuaggcggauggccauucuuggggauaccgcaugggacuucggaagcaucgguggcguuuuuacauccguggggaagcugguccaucagauuuucggaacggcguacggcguguuguuuucugguguaagcuggaccaugaagauagggaucggcgugcuccugacuugguuaggacuuaauucacgaaguacaucccuaagcaugaccuguauugcuguuggccucgucacacuguaccuuggggugauggugcaggccuga

SEQ ID NO: 1752 - RNA, 2043 nt, Artificial Sequence
  derived and/or modified CDS sequence (opt3) from DENV-1 CYD23__SSopt-pr(D104A)MEdelstem_TM,(F108S)-JEV
augaagaggaaaaagagcgugaccaugcugcucaugcuuaugcccacagcccuggcuuuccacuugacuacgagaggcggggagccucauaugaucgucuccaaacaggaacggggaaagucuuuacuguuuaaaaccucagccgguguuaacaugugcacacuaauugccauggaccucggcgagcugugugaagauacuaugaccuacaagugcccacgcauaacagaggcggaaccggacgauguggacuguuggugcaaugcuaccgauacuuggguaacauaugggaccuguagucaaacgggagagcaccgacgugccaagagaagcguggcacuugcaccccaugucggccuggguuuggagacuaggaccgaaacauggauguccucugagggggcuuggaaacagauccagcggguggaaacuugggcacuccgccacccuggauucaccguuauugcccuguuucuggcucaugccaucggcacaucgauuacccagaagggcaucauauucauccucuuaaugcuggugacgccaucaauggcgaugagaugcgucgggauuggaagcagggacuuuguggagggucuuaguggcgcaacuuggguagauguuguguuggagcacggguccugugucacaaccauggccaaagacaagcccacucuggauaucgaacuacucaaaacagaggugaccaacccugcugugcugcggaaacuuugcauugaagccaagaucucuaauacgaccacagacagccgcuguccaacucaaggagaggcaacccuggucgaggaacaggaugcuaacuucguuugccgaagaacauuuguggacaggggcugggguaauggguguggauuguccggcaagggcucacucauaacuugcgccaaguucaaaugcguaaccaagcuggaggggaaaauugugcaguacgaaaacuuaaaguauagugucaucgugacaguucacaccggagaucagcaucaaguggguaaugagagcacugaacacggcacgacagcgaccauuacuccccaggccccuaccacagagauccagcugaccgacuacggggcacucacucuugacuguucuccacggacaggacuggauuuuaacgaaauggucuugcuaacgaugaaagagaaguccuggcuggugcauaagcagugguuccucgaccugccgcuucccuggaccucaggcgcuagcacaagucaagagacuuggaaucgucaggaucuguugguaaccuuuaaaacagcccacgcuaagaaacaggaaguugugguccucgguucucaagagggggccaugcacacugcacugaccggcgccacggaaauccagaccuccggaacaacuaccauuuucgcuggccauuuaaagugccgccugaaaauggacaagcuaacacucaaggggaugagcuaugugauguguacuggaucguuuaaacuggagaaggaagucgcggagacccagcacgguacggugcuuguucagauaaaauacgagggcacagaugcaccuugcaagaucccauucucuacccaagacgaaaaaggggugacucagaacggaagauugauuacagccaaucccaucguaaccgauaaggagaagccugucaacauagaagcugagccacccuucggcgaguccuauauugugaucggugccggggaaaaagcacugaagcucucaugguuuaaaaagggcaguacucugggaaaagccuucagcaccacacuuaagggcgcucagaggcuggccgcauugggggacacggcgugggauuuuggauccaucgguggcguuuucaauucuauugggcgggcugugcaucaggucuuuggaggcgccuuccgaacccucuuuggugggaugagcuggaucacucaaggccugaugggagcauuacugcuauggaugggcgugaacgcccgcgacagaucaauugcucucgccuuccuggcaacagggggaguacuuguguuuuuggcuaccaauguucacgccuga

SEQ ID NO: 1753 - RNA, 2043 nt, Artificial Sequence
  derived and/or modified CDS sequence (opt3) from DENV-1 CYD23__SSopt-prMEdelstem_TM,(H261N)-JEV
augaagaggaaaaagagcgugaccaugcugcucaugcuuaugcccacagcccuggcuuuccacuugacuacgagaggcggggagccucauaugaucgucuccaaacaggaacggggaaagucuuuacuguuuaaaaccucagcaggaguuaacaugugcacacuaauugccauggaccucggcgagcugugugaagauacuaugaccuacaagugcccacgcauaacagaggcggaaccggacgauguggacuguuggugcaaugcuaccgauacuuggguaacauaugggaccuguagucaaacgggagagcaccgacgugacaagagaagcguggcccuugcaccccaugucggccuggguuuggagacuaggaccgaaacauggauguccucugagggggccuggaaacagauccagcggguggaaacuugggcucuccgccacccuggauucaccguuauugcacuguuucuggcccaugcuaucggcacaucgauuacccagaagggcaucauauucauccucuuaaugcuggugacgccaucaauggccaugagaugcgucgggauuggaagcagggauuuuguggagggucuuaguggcgcgacuuggguagacguuguguuggagcacggguccugugucacaaccauggcaaaagauaagcccacucuggacaucgaacuacucaaaacagaggugaccaacccugccgugcugcggaaacuuugcauugaagcuaagaucucuaauacgaccacagauagccgcuguccaacucaaggagaggccacccuggucgaggaacaggacgcaaacuucguuugccgaagaacauuuguggauaggggcugggguaauggguguggauuguucggcaagggcucccucauaacuugcgcuaaguuuaaaugcguaaccaagcuggaggggaaaauugugcaguacgaaaacuuaaaguauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccacggacaggacuggacuucaacgaaauggucuugcuaacgaugaaagagaagucuuggcuggugcauaagcagugguuucucgaucugccgcuucccuggaccuccggcgcaucaacuagccaagagacauggaaucgucaggaccuguugguaaccuucaaaacagcucacgccaagaaacaggaaguugugguccucgguagucaagagggggcuaugaacacugcccugaccggcgcaacggaaauccagaccucuggaacaacuaccauuuuugccggccacuuaaagugccgccugaaaauggauaagcuaacacucaaggggauguccuaugugauguguacugguagcuucaaacuggagaaggaagucgcugagacccagcaugguacggugcuuguucagauaaaauacgagggcacagacgcgccuugcaagaucccauucucgacccaagaugaaaaaggggugacucagaauggaagauugauuacagcaaaccccaucguaaccgacaaggagaagccugucaauauagaagccgagccacccuuuggcgagucuuauauugugaucggugcuggggaaaaagcccugaagcucuccugguucaaaaagggcucaacucugggaaaagcauuuaguaccacacuuaagggcgcccagaggcuggcugccuugggggauacggcaugggacuucggaagcaucgguggcguuuuuaacuccauugggcgggcggugcaccaggucuucggaggcgcuuuucgaacccucuucggugggaugucuuggaucacucaaggccugaugggagccuuacugcuauggaugggcgugaaugcacgcgauagaagcauugcccucgcuuuucuggccacagggggaguacuuguguucuuggcaaccaacguucaugcuuga

SEQ ID NO: 1754 - RNA, 2043 nt, Artificial Sequence
  derived and/or modified CDS sequence (opt3) from DENV-1 CYD23__SSopt-prMEdelstem_TM,(R188L,A267T)-JEV
augaagaggaaaaagagcgugaccaugcugcucaugcuuaugcccacagcccuggcuuuccacuugacuacgagaggcggggagccucauaugaucgucuccaaacaggaacggggaaagucuuuacuguuuaaaaccucagcaggaguuaacaugugcacacuaauugccauggaccucggcgagcugugugaagauacuaugaccuacaagugcccacgcauaacagaggcggaaccggacgauguggacuguuggugcaaugcuaccgauacuuggguaacauaugggaccuguagucaaacgggagagcaccgacgugacaagagaagcguggcccuugcaccccaugucggccuggguuuggagacuaggaccgaaacauggauguccucugagggggccuggaaacagauccagcggguggaaacuugggcucuccgccacccuggauucaccguuauugcacuguuucuggcccaugcuaucggcacaucgauuacccagaagggcaucauauucauccucuuaaugcuggugacgccaucaauggccaugagaugcgucgggauuggaagcagggauuuuguggagggucuuaguggcgcgacuuggguagacguuguguuggagcacggguccugugucacaaccauggcaaaagauaagcccacucuggacaucgaacuacucaaaacagaggugaccaacccugccgugcugcggaaacuuugcauugaagcuaagaucucuaauacgaccacagauagccgcuguccaacucaaggagaggccacccuggucgaggaacaggacgcaaacuucguuugccgaagaacauuuguggauaggggcugggguaauggguguggauuguucggcaagggcucccucauaacuugcgcuaaguuuaaaugcguaaccaagcuggaggggaaaauugugcaguacgaaaacuuaaaguauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccacugacaggauuggacuucaacgaaaugguccuacugacgaugaaagagaagucuuggcucgugcauaagcagugguuucuggaucuuccgcugcccuggaccuccggcgcaucaacuagccaagagacauggaaucggcaggacuugcucguaaccuucaaaacagcucacgccaagaaacaggaaguugugguccuggguagucaagagggggcuaugcacacugccuuaaccggcacgaccgaaauccagacaucuggaacuaccacaauuuuugcaggccaucugaagugccgucuaaaaauggauaagcucacucugaaggggauguccuaugugauguguaccgguagcuucaaacuugagaaggaagucgccgagacgcagcacgguacaguguugguucagauaaaauacgagggcaccgacgcuccuugcaagaucccauucucgacucaagaugaaaaaggggugacacagaacggacgccugauuaccgcgaaucccaucguaacugacaaggagaagccugucaacauagaagcagagccacccuuuggcgagucuuauauugugaucggugccggggaaaaagcucucaagcuguccugguucaaaaagggcucaacccuuggaaaagccuuuaguacaacgcugaagggcgcacagagauuggccgcucucggggauaccgccugggacuucggaagcaucgguggcguuuuuaauuccauugggagggcagugcaucaggucuucggaggcgcguuucggacucuguucggugggaugucuuggaucacacaaggcuuaaugggagcucugcuacucuggaugggcgugaacgcccgagaucgcagcauugcacuggccuuucuugcuaccgggggaguauugguguuccuggccacaaauguucacgcauga

SEQ ID NO: 1755 - RNA, 300 nt, Artificial Sequence
  derived and/or modified CDS sequence (opt3) from DENV-2 CYD2-T__C
augaacaaucagagaaagaaagccaagaacacccccuucaauaugcugaaaagggagcggaaccgcgugagcacaguccaacagcucacuaagcgauuuucccuuggcaugcugcaggggcguggaccuuugaaauuauucauggcucugguugcauuucuaagauuccucacgaucccaccgaccgccgguauucugaagagguggggcacaauaaagaaaucuaaggcgaucaaugugcuucggggguuucgcaaagaaauuggaagaaugcugaacaucuugaauaggcggcgccga

SEQ ID NO: 1756 - RNA, 342 nt, Artificial Sequence
  derived and/or modified CDS sequence (opt3) from DENV-2 CYD2-T__C-SSc
augaacaaucagagaaagaaagccaagaacacccccuucaauaugcugaaaagggagcggaaccgcgugagcacaguccaacagcucacuaagcgauuuucccuuggcaugcugcaggggcguggaccuuugaaauuauucauggcucugguugcauuucuaagauuccucacgaucccaccgaccgccgguauucugaagagguggggcacaauaaagaaaucuaaggcgaucaaugugcuucggggguuucgcaaagaaauuggaagaaugcugaacaucuugaauaggcggcgccgaucagcuggcaugauuaucaugcucauacccacuguaauggcc

SEQ ID NO: 1757 - RNA, 273 nt, Artificial Sequence
  derived and/or modified CDS sequence (opt3) from DENV-2 CYD2-T__pr
uuccaccugaccacaagaaacggcgagccccauaugaucgugagcaggcaggaaaaggggaaaucccuccuuuuuaagacugaggacggagucaauaugugcacgcugauggccauggauuugggugaauuaugugaggacaccauuacauacaaaugcccucugcuacggcaaaacgaaccagaggauauagacuguuggugcaauucuacuucaaccuggguuacauauggcaccuguacuacaaugggggagcaccgccgagaaaagcgu

SEQ ID NO: 1758 - RNA, 225 nt, Artificial Sequence
  derived and/or modified CDS sequence (opt3) from DENV-2 CYD2-T__M
agcguggcccuggucccccacguuggcauggggcucgagaccagaacagaaacuuggauguccucugagggagcuuggaagcaugugcagaggaucgaaacguggauucuucggcacccugguuucaccaugauggcagccauacuggcguacacaaucggcacuacccauuuucaacgcgcuuugauuuucaucuuacugacagccguaaccccaucaaugacu

SEQ ID NO: 1759 - RNA, 498 nt, Artificial Sequence
  derived and/or modified CDS sequence (opt3) from DENV-2 CYD2-T__prM
uuccaccugaccacaagaaacggcgagccccauaugaucgugagcaggcaggaaaaggggaaaucccuccuuuuuaagacugaggacggagucaauaugugcacgcugauggccauggauuugggugaauuaugugaggacaccauuacauacaaaugcccucugcuacggcaaaacgaaccagaggauauagacuguuggugcaauucuacuucaaccuggguuacauauggcaccuguacuacaaugggggagcaccgccgagaaaagcguaguguggcucucguaccgcaugugggaaugggccuggagaccagaacggaaacuuggaugagcuccgagggugcauggaaacacguccagaggaucgagaccuggauucuucggcaucccggguucacaaugauggccgcgauccuggcuuacacuauuggaaccacacacuuucagcgcgccuugaucuucauacuccugaccgcagugacgccuucuaugacu

SEQ ID NO: 1760 - RNA, 1485 nt, Artificial Sequence
  derived and/or modified CDS sequence (opt3) from DENV-2 CYD2-T__E
augagaugcaucggcaugagcaacagggacuucguggagggggucuccggagguucuuggguugauauugugcuggaacacggcucauguguaaccacaauggccaagaauaaacccacucucgacuuugagcuuauaaagacggaagcuaaacagccugcaacccugcggaaguacugcaucgaggccaaauugacaaacacuaccacagaaagucgcuguccaacccaaggggagccgagcuuaaaugaggaacaggauaagcgauucgugugcaagcauuccauggucgaccguggauggggcaacgguugugggcuguuuggaaaaggcggcauugugacuugcgcgauguucagauguaagaaaaauauggaggggaagguugugcagcccgaaaaccuagaguauacaaucgucauuaccccucacucuggagaggaacaugcuguggguaaugauacgggcaaacacgggaaggagaucaagauaacuccacagucgucaaucaccgaagccgagcucacaggauacggcacuguaaccauggaaugcagccccaggacaggucuggacuuuaacgagaugguucuucugcaaauggagaauaaagcaugguuggugcaucggcagugguuccucgaucugccucugccauggcuccccggggccgacacccagggaaguaacuggauucagaaggaaacguuagucacuuuuaaaaauccucacgcuaagaaacaagauguggugguccugggcucccaggagggcgcaaugcacacagcccuuaccggggcuacugaaauccagaugucuagcggaaacuugcuguucacaggucaucuaaagugucgccucagaauggacaaacugcagcuuaagggcauguccuauucaaugugcaccgggaaguuuaaaguugugaaggagauugccgaaacgcaacacggaaccaucguaauaagggugcaguacgagggcgaugguaguccauguaaaauuccguucgagaucauggaccuggaaaagcggcaugucuuggggcgccucauuacagugaaucccaucguuacugagaaagauagcccugugaacaucgaagcggagccacccuuuggcgacucuuauauuauaaucggagucgaaccuggccagcugaaguuaaauugguucaagaaaggguccucaauuggacaaauguuugagaccacaaugcgaggugcaaagagaauggccauccugggcgacacugcuugggauuucgggagccucggaggcguguucaccaguauagguaaagcccuucaccagguauuuggggcaauuuacggcgcugccuucucuggaguuuccuggacaaugaagauccugaucggcgugauuaucaccuggauugggaugaacagcaggucgacuucuuuguccgucacgcuagugcuggucggaauagugacacucuaucuggguguuauggugcaggcg

SEQ ID NO: 1761 - RNA, 1983 nt, Artificial Sequence
  derived and/or modified CDS sequence (opt3) from DENV-2 CYD2-T__prME
uuccaccugaccacaagaaauggcgagccccauaugaucgugagcaggcaggaaaaggggaaaucccuccuuuuuaagacugaggacggagucaauaugugcacgcugauggccauggauuugggugaauuaugugaggacaccauuacauacaaaugcccucugcuacggcaaaacgaaccagaggauauagacuguuggugcaauucuacuucaaccuggguuacauauggcaccuguacuacaaugggggagcaccgccgagaaaagcguaguguggcucucguaccgcaugugggaaugggccuggagaccagaacggaaacuuggaugagcuccgagggugcauggaaacacguccagaggaucgagaccuggauucuucggcaucccggguucacaaugauggccgcgauccuggcuuacacuauuggaaccacacacuuucagcgcgccuugaucuucauacuccugaccgcagugacgccuucuaugacuaugagaugcaucggcaugucgaacagggauuuuguugaaggcgugucagggggaagcugggucgacauugugcuggagcacgguaguuguguaacaaccauggccaagaauaagccaacucucgauuucgaauuaaucaaaacagaggcuaagcagcccgcaacccugcggaaauauugcauugaagccaaacuuacgaacaccacaacugagucccgcuguccuacccaaggcgagccaucuuugaaugaggaacaggacaagcgauuuguuugcaagcauagcaugguggauagaggguggggaaacggcuguggucuguucgggaagggaggcaucgucacaugcgcuauguuuaggugcaaaaagaauauggaaggcaaaguggugcagcccgagaaccuagaauacacuauagucauuaccccucacuccggggaggagcaugccguuggaaaugacacagguaagcacggcaaagaaaucaagauuaccccacagucaaguaucacugaggcggaacucacgggguauggaacagugaccauggaguguagcccgcggacuggccuggauuucaacgaaaugguacuucugcaaauggagaauaaagcaugguuggugcaccgucagugguuucucgaccugcccuuaccuuggcugccaggugccgauacccaggggucuaacuggauccagaaggagacacucgucaccuucaagaauccccaugcuaaaaagcaagacgugguugugcuuggcucccaggaaggagccaugcacacugcacugacaggcgcuacggagauucagaugucaagcgggaacuugcuauuuaccggacaucugaaaugccgccucagaauggacaagcugcaacuuaaagguaugaguuacucuauguguacuggcaaguucaaggucgugaaagaaauagccgagacacagcacgggaccaucguaauuaggguucaguaugagggagauggcuccccuugcaagaucccauucgaaauaauggaccuggagaaacggcauguguugggucgacucauuacagucaaccccaucgugacugaaaaggauagcccggucaauaucgaggcggaaccucccuuuggggacucguacauuaucauuggcguggagccaggacagcugaaauuaaacugguucaagaaggggucuuccauaggccaaauguuugagaccacgaugcgcggagccaaaagaauggcaauccugggugauaccgcuugggacuucggcucacuagggggaguuuuuacaaguauuggcaaggcccuccaccagguguucggugcuaucuacggggccgcauuuagcggcguauccuggacuaugaaaauccugauuggagucauaaucaccuggauuggcaugaacucuaggagcacaucacuuagugugacuuugguucugguggggaucgucacccucuaucugggagugaugguacaggcc

SEQ ID NO: 1762 - RNA, 2025 nt, Artificial Sequence
  derived and/or modified CDS sequence (opt3) from DENV-2 CYD2-T__SSc-prME
agcgccggcaugaucauuaugcugauacccaccgugauggcuuuccaccucacaacuagaaacggggagccucauaugaucgucuccaggcaggaaaagggaaaaucucuucuguuuaagacggaggacgguguuaauaugugcaccuugauggcaauggauuuaggcgaacugugugaggacacaauuacuuacaaaugcccacuacuccggcaaaacgaaccggaggauaucgacuguuggugcaauucaaccaguacaugggugaccuaugggacuuguacaaccaugggagagcaccgccgagaaaagcguagcguagcccuggugccccaugucggcaugggucuugagacgagaacugaaaccuggauguccucugagggggcguggaaacacgugcagaggauugagacauggauccugcggcauccuggauucacuaugauggcugccauauuggcauacaccaucggcacaacccacuuucagcgcgcccucauuuucauccugcugacggcuguuacuccaucgaugacaaugagaugcauuggcaugucaaacagggauuuuguggaaggggucagcggagguaguuggguggacaucguacucgagcacggcuccuguguuaccacuauggcaaagaauaagcccacauuagauuucgaacugauaaaaaccgaggccaagcagccugcuacgcuucggaaauauugcauugaagccaaguugaccaacacaacuaccgagucucgcuguccaacacaaggggagcccagccugaaugaggaacaggacaaacgauuugugugcaagcauuccauggucgauagaggauggggcaacgguugugggcuauucggaaagggcggcaucgugacuugcgcgauguuuaggugcaaaaagaauauggaagggaaagugguccagccugagaaccucgaauacaccauuguuaucacaccacacucaggagaggagcaugcaguggguaaugacaccggcaagcacgggaaagaaaucaagauuacuccgcagaguagcauaacggaggccgaacugacaggauauggcaccguaacuauggaguguucuccccggaccggucuugauuucaacgaaauggugcuguugcaaauggagaauaaggcuuggcucguccaccgucagugguuucuggacuuaccucugccauggcuccccggggccgauacacagggcuccaacuggauccagaaggagacccuugugacuuucaagaauccucaugcuaaaaagcaagacguugugguccugggaucacaggaaggcgcaaugcacacagccuugacgggggcgaccgagauucagaugagcaguggaaaccuacuguuuacuggucaucucaaaugccgccugagaauggacaaacuucaacugaaaggcaugucuuacuccauguguacagggaaguucaaggugguaaaagaaaucgccgagacccagcacggaacaauaguuauuagggugcaguaugagggcgaugguagcccaugcaagauccccuucgaaaucauggacuuggagaaacggcauguccucgggcgacugauuacugugaacccgaucgucaccgaaaaggauucgccugugaauauugaggcagaacccccauuuggcgacucuuacauaaucauuggaguugagccuggccaguuaaaacugaacugguucaagaagggguccucaaucggacaaauguuugagacgaccaugcgcggugcuaaaagaauggccauccuaggcgauacagcuugggacuucgggagucucggaggcguguuuacuagcauugguaaggcccugcaccagguauucggggcaauauacggcgccgcuuuuuccggagucucuuggaccaugaaaauccuuauuggcgugaucauuacauggaucgggaugaauagcaggucaaccaguuuguccguuacucuggugcucgucggaauagugacgcuguaucuuggcguaauggugcaggcg

SEQ ID NO: 1763 - RNA, 2325 nt, Artificial Sequence
  derived and/or modified CDS sequence (opt3) from DENV-2 CYD2-T__C-prME
augaauaaucagagaaagaaagccaagaacacccccuucaauaugcugaaaagggagcggaaccgcgugagcacaguccaacagcucacuaagcgauuuucccuuggcaugcugcaggggcguggaccuuugaaauuauucauggcucugguugcauuucuaagauuccucacgaucccaccgaccgccgguauucugaagagguggggcacaauaaagaaaucuaaggcgaucaaugugcuucggggguuucgcaaagaaauuggaagaaugcugaacaucuugaauaggcggcgccgaucagcuggcaugauuaucaugcucauacccacuguaauggccuuccaccugaccacaagaaacggugagccucauaugaucgugaguaggcaggaaaaggggaaaagccugcucuuuaagaccgaggacggagucaauaugugcacuuuaauggcaauggaucugggcgaacuuugugaggacacaauuaccuacaagugcccauugcugcggcaaaacgagcccgaagauaucgacuguuggugcaauuccacgucuacuugggugaccuauggcacauguacuaccaugggggagcaccgucgcgaaaagagaucgguugcccuagugccucaugucggaaugggucucgagacaaggaccgagacguggaugucaagcgaaggcgcuuggaagcacgugcagcggauugagacuuggauccugcgacauccaggguucacaaugauggcagccauacuugcuuacaccauuggaacuacacacuuucagcgcgcccugaucuucauuuugcucaccgcgguaacgcccaguaugaccaugagaugcaucggcauguccaacagggauuuuguugaaggugugucugggggaagcugggucgacaucgugcuggagcacggcuccugugugacaacuauggccaaaaauaagccuaccuuagauuucgaacugauuaaaacagaggcaaagcagccagcuacucuccggaaauauugcauagaggccaaacuuaccaacacaaccacugaaucacgcuguccgacgcaaggcgagcccagucugaaugaagaacaggacaagagauuugucugcaaacauagcaugguugauaggggguggggaaacgguuguggcuuguucgggaagggaggcaucgugacaugcgcaauguuccguugcaaaaagaacauggaagguaaaguagugcagccugagaaucuagaguacaccauugucaucacuccacacucuggggaggagcaugcugugggcaacgacaccggaaagcacggcaaggaaauaaaaauuacaccccaguccucaaucaccgaggccgaacugacuggguauggaacaguuacgauggaguguagcccucggaccggucucgauuuuaaugagauggugcugcuucaaauggaaaacaaggcguggcugguccaccgacagugguucuuggaccucccacugcccugguuaccgggcgccgauacucaggggaguaauuggauccaaaaagagacacuggugaccuuuaagaacccucaugcuaaaaagcaggacguaguugugcuaggaucucaggaaggcgcaaugcacacagcccucacuggugcuaccgagauucagauguccagcgggaaucugcuuuucacgggccauuugaagugcagacugaggauggacaaacuccaacugaagggaaugucguacucuauguguaccggcaaauuuaaggucgugaaagagaucgccgaaacacagcacgggacuauugucauacgcgugcaguaugagggagaugguucccccugcaagaucccauucgaaauuauggaccuugagaagcggcauguucugggcagauugaucaccgugaacccuaucguaacagaaaaagauucacccgucaauauugaggcagagccacccuuuggggacaguuacauaaucauuggaguggaaccuggccagcucaagcugaacugguucaaaaaggguagcuccaucgggcaaauguuugagacuaccaugaggggcgccaaacgcauggcuauuuuaggagauacggcgugggacuucggcucucuagggggaguuuuuacaagcaucggcaaggcacugcaccagguguucggugccauauacggggcugccuuuucaggagucaguuggaccaugaaaauccucauuggcgugaucauuacuuggaucgguaugaacucccgaagcacaucucugucaguaacccuuguguugguuggcauagucacucuguaucucggggugauggugcaggca

SEQ ID NO: 1764 - RNA, 45 nt, Artificial Sequence
  derived and/or modified CDS sequence (opt3) from DENV-2 CYD2-T__SSc
augagcgccggcaugaucauuaugcugauacccaccgugauggcu

SEQ ID NO: 1765 - RNA, 57 nt, Artificial Sequence
  derived and/or modified CDS sequence (opt3) from DENV-2 CYD2-T__SSopt
augaagagaaagaaaagcgccggcaugaucauuaugcugauacccaccgugauggcu

SEQ ID NO: 1766 - RNA, 57 nt, Artificial Sequence
  derived and/or modified CDS sequence (opt3) from DENV-2 CYD2-T__SSm
auguuccagagagcccugaucuuuauucuccuuaccgcugugacacccagcaugacu

SEQ ID NO: 1767 - RNA, 1488 nt, Artificial Sequence
  derived and/or modified CDS sequence (opt3) from DENV-2 CYD2-T__E
augagaugcaucggcaugagcaacagggacuucguggagggggucuccggagguucuuggguugauauugugcuggaacacggcucauguguaaccacaauggccaagaauaaacccacucucgacuuugagcuuauaaagacggaagcuaaacagccugcaacccugcggaaguacugcaucgaggccaaauugacaaacacuaccacagaaagucgcuguccaacccaaggggagccgagcuuaaaugaggaacaggauaagcgauucgugugcaagcauuccauggucgaccguggauggggcaacgguugugggcuguuuggaaaaggcggcauugugacuugcgcgauguucagauguaagaaaaauauggaggggaagguugugcagcccgaaaaccuagaguauacaaucgucauuaccccucacucuggagaggaacaugcuguggguaaugauacgggcaaacacgggaaggagaucaagauaacuccacagucgucaaucaccgaagccgagcucacaggauacggcacuguaaccauggaaugcagccccaggacaggucuggacuuuaacgagaugguucuucugcaaauggagaauaaagcaugguuggugcaucggcagugguuccucgaucugccucugccauggcuccccggggccgacacccagggaaguaacuggauucagaaggaaacguuagucacuuuuaaaaauccucacgcuaagaaacaagauguggugguccugggcucccaggagggcgcaaugcacacagcccuuaccggggcuacugaaauccagaugucuagcggaaacuugcuguucacaggucaucuaaagugucgccucagaauggacaaacugcagcuuaagggcauguccuauucaaugugcaccgggaaguuuaaaguugugaaggagauugccgaaacgcaacacggaaccaucguaauaagggugcaguacgagggcgaugguaguccauguaaaauuccguucgagaucauggaccuggaaaagcggcaugucuuggggcgccucauuacagugaaucccaucguuacugagaaagauagcccugugaacaucgaagcggagccacccuuuggcgacucuuauauuauaaucggagucgaaccuggccagcugaaguuaaauugguucaagaaaggguccucaauuggacaaauguuugagaccacaaugcgaggugcaaagagaauggccauccugggcgacacugcuugggauuucgggagccucggaggcguguucaccaguauagguaaagcccuucaccagguauuuggggcaauuuacggcgcugccuucucuggaguuuccuggacaaugaagauccugaucggcgugauuaucaccuggauugggaugaacagcaggucgacuucuuuguccgucacgcuagugcuggucggaauagugacacucuaucuggguguuauggugcaggcguga

SEQ ID NO: 1768 - RNA, 1182 nt, Artificial Sequence
  derived and/or modified CDS sequence (opt3) from DENV-2 CYD2-T__EdelTM-variant (aa1-394)
augagaugcaucggcaugagcaacagggacuucguggagggggucuccggagguucuuggguugauauugugcuggaacacggcucauguguaaccacaauggccaagaauaaacccacucucgacuuugagcuuauaaagacggaagcuaaacagccugcaacccugcggaaguacugcaucgaggccaaauugacaaacacuaccacagaaagucgcuguccaacccaaggggagccgagcuuaaaugaggaacaggauaagcgauucgugugcaagcauuccauggucgaccguggauggggcaacgguugugggcuguuuggaaaaggcggcauugugacuugcgcgauguucagauguaagaaaaauauggaggggaagguugugcagcccgaaaaccuagaguauacaaucgucauuaccccucacucuggagaggaacaugcuguggguaaugauacgggcaaacacgggaaggagaucaagauaacuccacagucgucaaucaccgaagccgagcucacaggauacggcacuguaaccauggaaugcagccccaggacaggucuggacuuuaacgagaugguucuucugcaaauggagaauaaagcaugguuggugcaucggcagugguuccucgaucugccucugccauggcuccccggggccgacacccagggaaguaacuggauucagaaggaaacguuagucacuuuuaaaaauccucacgcuaagaaacaagauguggugguccugggcucccaggagggcgcaaugcacacagcccuuaccggggcuacugaaauccagaugucuagcggaaacuugcuguucacaggucaucuaaagugucgccucagaauggacaaacugcagcuuaagggcauguccuauucaaugugcaccgggaaguuuaaaguugugaaggagauugccgaaacgcaacacggaaccaucguaauaagggugcaguacgagggcgaugguaguccauguaaaauuccguucgagaucauggaccuggaaaagcggcaugucuuggggcgccucauuacagugaaucccaucguuacugagaaagauagcccugugaacaucgaagcggagccacccuuuggcgacucuuauauuauaaucggagucgaaccuggccagcugaaguuaaauugguucaagaaa

SEQ ID NO: 1769 - RNA, 1272 nt, Artificial Sequence
  derived and/or modified CDS sequence (opt3) from DENV-2 CYD2-T__EdelTM-variant (aa1-424)
augagaugcaucggcaugagcaacagggacuucguggagggggucuccggagguucuuggguugauauugugcuggaacacggcucauguguaaccacaauggccaagaauaaacccacucucgacuuugagcuuauaaagacggaagcuaaacagccugcaacccugcggaaguacugcaucgaggccaaauugacaaacacuaccacagaaagucgcuguccaacccaaggggagccgagcuuaaaugaggaacaggauaagcgauucgugugcaagcauuccauggucgaccguggauggggcaacgguugugggcuguuuggaaaaggcggcauugugacuugcgcgauguucagauguaagaaaaauauggaggggaagguugugcagcccgaaaaccuagaguauacaaucgucauuaccccucacucuggagaggaacaugcuguggguaaugauacgggcaaacacgggaaggagaucaagauaacuccacagucgucaaucaccgaagccgagcucacaggauacggcacuguaaccauggaaugcagccccaggacaggucuggacuuuaacgagaugguucuucugcaaauggagaauaaagcaugguuggugcaucggcagugguuccucgaucugccucugccauggcuccccggggccgacacccagggaaguaacuggauucagaaggaaacguuagucacuuuuaaaaauccucacgcuaagaaacaagauguggugguccugggcucccaggagggcgcaaugcacacagcccuuaccggggcuacugaaauccagaugucuagcggaaacuugcuguucacaggucaucuaaagugucgccucagaauggacaaacugcagcuuaagggcauguccuauucaaugugcaccgggaaguuuaaaguugugaaggagauugccgaaacgcaacacggaaccaucguaauaagggugcaguacgagggcgaugguaguccauguaaaauuccguucgagaucauggaccuggaaaagcggcaugucuuggggcgccucauuacagugaaucccaucguuacugagaaagauagcccugugaacaucgaagcggagccacccuuuggcgacucuuauauuauaaucggagucgaaccuggccagcugaaguuaaauugguucaagaaaggguccucaauuggacaaauguuugagaccacaaugcgaggugcaaagagaauggccauccugggcgacacugcuugggauuucgggagc

SEQ ID NO: 1770 - RNA, 1263 nt, Artificial Sequence
  derived and/or modified CDS sequence (opt3) from DENV-2 CYD2-T__EdelTM-variant (aa1-421)
augagaugcaucggcaugagcaacagggacuucguggagggggucuccggagguucuuggguugauauugugcuggaacacggcucauguguaaccacaauggccaagaauaaacccacucucgacuuugagcuuauaaagacggaagcuaaacagccugcaacccugcggaaguacugcaucgaggccaaauugacaaacacuaccacagaaagucgcuguccaacccaaggggagccgagcuuaaaugaggaacaggauaagcgauucgugugcaagcauuccauggucgaccguggauggggcaacgguugugggcuguuuggaaaaggcggcauugugacuugcgcgauguucagauguaagaaaaauauggaggggaagguugugcagcccgaaaaccuagaguauacaaucgucauuaccccucacucuggagaggaacaugcuguggguaaugauacgggcaaacacgggaaggagaucaagauaacuccacagucgucaaucaccgaagccgagcucacaggauacggcacuguaaccauggaaugcagccccaggacaggucuggacuuuaacgagaugguucuucugcaaauggagaauaaagcaugguuggugcaucggcagugguuccucgaucugccucugccauggcuccccggggccgacacccagggaaguaacuggauucagaaggaaacguuagucacuuuuaaaaauccucacgcuaagaaacaagauguggugguccugggcucccaggagggcgcaaugcacacagcccuuaccggggcuacugaaauccagaugucuagcggaaacuugcuguucacaggucaucuaaagugucgccucagaauggacaaacugcagcuuaagggcauguccuauucaaugugcaccgggaaguuuaaaguugugaaggagauugccgaaacgcaacacggaaccaucguaauaagggugcaguacgagggcgaugguaguccauguaaaauuccguucgagaucauggaccuggaaaagcggcaugucuuggggcgccucauuacagugaaucccaucguuacugagaaagauagcccugugaacaucgaagcggagccacccuuuggcgacucuuauauuauaaucggagucgaaccuggccagcugaaguuaaauugguucaagaaaggguccucaauuggacaaauguuugagaccacaaugcgaggugcaaagagaauggccauccugggcgacacugcuugggau

SEQ ID NO: 1771 - RNA, 2031 nt, Artificial Sequence
  derived and/or modified CDS sequence (opt3) from DENV-2 CYD2-T__SSc-prME
augagcgccggcaugaucauuaugcugauacccaccgugauggcuuuccaccucacaacuagaaacggggagccucauaugaucgucuccaggcaggaaaagggaaaaucucuucuguuuaagacggaggacgguguuaauaugugcaccuugauggcaauggauuuaggcgaacugugugaggacacaauuacuuacaaaugcccacuacuccggcaaaacgaaccggaggauaucgacuguuggugcaauucaaccaguacaugggugaccuaugggacuuguacaaccaugggagagcaccgccgagaaaagcguagcguagcccuggugccccaugucggcaugggucuugagacgagaacugaaaccuggauguccucugagggggcguggaaacacgugcagaggauugagacauggauccugcggcauccuggauucacuaugauggcugccauauuggcauacaccaucggcacaacccacuuucagcgcgcccucauuuucauccugcugacggcuguuacuccaucgaugacaaugagaugcauuggcaugucaaacagggauuuuguggaaggggucagcggagguaguuggguggacaucguacucgagcacggcuccuguguuaccacuauggcaaagaauaagcccacauuagauuucgaacugauaaaaaccgaggccaagcagccugcuacgcuucggaaauauugcauugaagccaaguugaccaacacaacuaccgagucucgcuguccaacacaaggggagcccagccugaaugaggaacaggacaaacgauuugugugcaagcauuccauggucgauagaggauggggcaacgguugugggcuauucggaaagggcggcaucgugacuugcgcgauguuuaggugcaaaaagaauauggaagggaaagugguccagccugagaaccucgaauacaccauuguuaucacaccacacucaggagaggagcaugcaguggguaaugacaccggcaagcacgggaaagaaaucaagauuacuccgcagaguagcauaacggaggccgaacugacaggauauggcaccguaacuauggaguguucuccccggaccggucuugauuucaacgaaauggugcuguugcaaauggagaauaaggcuuggcucguccaccgucagugguuucuggacuuaccucugccauggcuccccggggccgauacacagggcuccaacuggauccagaaggagacccuugugacuuucaagaauccucaugcuaaaaagcaagacguugugguccugggaucacaggaaggcgcaaugcacacagccuugacgggggcgaccgagauucagaugagcaguggaaaccuacuguuuacuggucaucucaaaugccgccugagaauggacaaacuucaacugaaaggcaugucuuacuccauguguacagggaaguucaaggugguaaaagaaaucgccgagacccagcacggaacaauaguuauuagggugcaguaugagggcgaugguagcccaugcaagauccccuucgaaaucauggacuuggagaaacggcauguccucgggcgacugauuacugugaacccgaucgucaccgaaaaggauucgccugugaauauugaggcagaacccccauuuggcgacucuuacauaaucauuggaguugagccuggccaguuaaaacugaacugguucaagaagggguccucaaucggacaaauguuugagacgaccaugcgcggugcuaaaagaauggccauccuaggcgauacagcuugggacuucgggagucucggaggcguguuuacuagcauugguaaggcccugcaccagguauucggggcaauauacggcgccgcuuuuuccggagucucuuggaccaugaaaauccuuauuggcgugaucauuacauggaucgggaugaauagcaggucaaccaguuuguccguuacucuggugcucgucggaauagugacgcuguaucuuggcguaauggugcaggcguga

SEQ ID NO: 1772 - RNA, 2031 nt, Artificial Sequence
  derived and/or modified CDS sequence (opt3) from DENV-2 CYD2-T__SSc-prME(F108S)
augagcgccggcaugaucauuaugcugauacccaccgugauggcuuuccaccucacaacuagaaauggggagccucauaugaucgucuccaggcaggaaaagggaaaaucucuucuguuuaagacggaggacgguguuaauaugugcaccuugauggcaauggauuuaggcgaacugugugaggacacaauuacuuacaaaugcccacuacuccggcaaaacgaaccggaggauaucgacuguuggugcaauucaaccaguacaugggugaccuaugggacuuguacaaccaugggagagcaccgccgagaaaagcguagcguagcccuggugccccaugucggcaugggucuugagacgagaacugaaaccuggauguccucugagggggcguggaaacacgugcagaggauugagacauggauccugcggcauccuggauucacuaugauggcugccauauuggcauacaccaucggcacaacccacuuucagcgcgcccucauuuucauccugcugacggcuguuacuccaucgaugacaaugagaugcauuggcaugucaaacagggauuuuguggaaggggucagcggagguaguuggguggacaucguacucgagcacggcuccuguguuaccacuauggcaaagaauaagcccacauuagauuucgaacugauaaaaaccgaggccaagcagccugcuacgcuucggaaauauugcauugaagccaaguugaccaacacaacuaccgagucucgcuguccaacacaaggggagcccagccugaaugaggaacaggacaaacgauuugugugcaagcauuccauggucgauagaggauggggcaacgguugugggcuaucaggaaagggcggcaucgugacuugcgcgauguucaggugcaaaaagaauauggaagggaaagugguccagccugagaaccucgaauacaccauuguuaucacaccacacaguggagaggagcaugcaguggguaaugacaccggcaagcacgggaaagaaaucaagauuacuccgcagagcucuauaacggaggccgaacugacaggauauggcaccguaacuauggaguguucaccccggaccggucuugauuuuaacgaaauggugcuguugcaaauggagaauaaggcuuggcucguccaccgucagugguuccuggacuuaccucugccauggcuccccggggccgauacacagggcuccaacuggauccagaaggagacccuugugacuuuuaagaauccucaugcuaaaaagcaagacguugugguccugggaagccaggaaggcgcaaugcacacagccuugacgggggcgaccgagauucagaugaguucuggaaaccuacuguucacuggucaucucaaaugccgccugagaauggacaaacuucaacugaaaggcauguccuacagcauguguacagggaaguuuaaggugguaaaagaaaucgccgagacccagcacggaacaauaguuauuagggugcaguaugagggcgaugguucgccaugcaagauccccuucgaaaucauggacuuggagaaacggcauguccucgggcgacugauuacugugaacccgaucgucaccgaaaaggauucuccugugaauauugaggcagaacccccauucggcgacuccuacauaaucauuggaguugagccuggccaguuaaaacugaacugguuuaagaaggggucaaguaucggacaaauguucgagacgaccaugcgcggugcuaaaagaauggccauccuaggcgauacagcuugggacuuugggagccucggaggcguguucacuuccauugguaaggcccugcaccagguauuuggggcaauauacggcgccgcuuucucuggagucagcuggaccaugaaaauccuuauuggcgugaucauuacauggaucgggaugaacucaaggaguacuuccuugagcguuacccuggugcucgucggaauagugacgcuguaucuuggcguaauggugcaggcguga

SEQ ID NO: 1773 - RNA, 2031 nt, Artificial Sequence
  derived and/or modified CDS sequence (opt3) from DENV-2 CYD2-T__SSc-prMEdelstem_TM-JEV
augagcgccggcaugaucauuaugcugauacccaccgugauggcuuuccaccucacaacuagaaacggggagccucauaugaucgucuccaggcaggaaaagggaaaaucucuucuguuuaagacggaggacgguguuaauaugugcaccuugauggcaauggauuuaggcgaacugugugaggacacaauuacuuacaaaugcccacuacuccggcaaaacgaaccggaggauaucgacuguuggugcaauucaaccaguacaugggugaccuaugggacuuguacaaccaugggagagcaccgccgagaaaagcguagcguagcccuggugccccaugucggcaugggucuugagacgagaacugaaaccuggauguccucugagggggcguggaaacacgugcagaggauugagacauggauccugcggcauccuggauucacuaugauggcugccauauuggcauacaccaucggcacaacccacuuucagcgcgcccucauuuucauccugcugacggcuguuacuccaucgaugacaaugagaugcauuggcaugucaaacagggauuuuguggaaggggucagcggagguaguuggguggacaucguacucgagcacggcuccuguguuaccacuauggcaaagaauaagcccacauuagauuucgaacugauaaaaaccgaggccaagcagccugcuacgcuucggaaauauugcauugaagccaaguugaccaacacaacuaccgagucucgcuguccaacacaaggggagcccagccugaaugaggaacaggacaaacgauuugugugcaagcauuccauggucgauagaggauggggcaacgguugugggcuauucggaaagggcggcaucgugacuugcgcgauguuuaggugcaaaaagaauauggaagggaaagugguccagccugagaaccucgaauacaccauuguuaucacaccacacucaggagaggagcaugcaguggguaaugacaccggcaagcacgggaaagaaaucaagauuacuccgcagaguagcauaacggaggccgaacugacaggauauggcaccguaacuauggaguguucuccccggaccggucuugauuucaacgaaauggugcuguugcaaauggagaauaaggcuuggcucguccaccgucagugguuucuggacuuaccucugccauggcuccccggggccgauacacagggcuccaacuggauccagaaggagacccuugugacuuucaagaauccucaugcuaaaaagcaagacguugugguccugggaucacaggaaggcgcuaugcacacagccuugacgggggcgaccgagauucagaugagcaguggaaaccuacuguuuacuggucaucucaaaugccgccugagaauggacaaacuucaacugaaaggcaugucuuacuccauguguacagggaaguucaaggugguaaaagaaaucgccgagacccagcacggaacaauaguuauuagggugcaguaugagggcgaugguagcccaugcaagauccccuucgaaaucauggacuuggagaaacggcauguccucgggcgacugauuacugugaacccgaucgucaccgaaaaggauucgccugugaauauugaggcagaacccccauuuggcgacucuuacauaaucauuggaguugagccuggccaguuaaaacugaacugguucaagaagggguccacgcuaggaaaggcuuuuucaaccacacucaaaggugcccaacgccuggcugcccuuggcgauacugcaugggacuucgggaguaucggaggcguguuuaauagcaucgguagagccguacaccaggucuucgggggcgcuuuuaggaccuuguucggaggcauguccuggauuacacaggggcugaugggagcgcuccugcuuuggaugggcgugaacgcacgggaucgcucuauagcccuggcauuuuuggccacuggugggguucucguguuccuggcaaccaauguccacgccuga

SEQ ID NO: 1774 - RNA, 1332 nt, Artificial Sequence
  derived and/or modified CDS sequence (opt3) from DENV-2 CYD2-T__SSm-EdelTM
auguuccagagagcccugaucuuuauucuccuuaccgcugugacacccagcaugacuaugaggugcauaggcauguccaaccgggacuucgucgaggggguuucuggagguucauggguggauaucguacuggaacacggcaguugugugacgaccauggcaaagaauaaaccuacauuggacuuugaguuaauuaagacugaagccaaacaaccagcgacccugcgcaaguacugcaucgaggcuaaacuaacaaacaccacuacagaaagccgauguccgacccagggggagcccucccucaaugaggaacaggauaagcguuucgucugcaagcauucuaugguggacagaggauggggcaacgguugugggcuguuuggaaaaggcggcauuguuacgugcgccauguucagguguaagaaaaauauggaggggaaggugguccagccugaaaaccuugaguauacuaucgugauaaccccacacucgggagaggaacaugcaguagguaaugauacaggcaaacacgggaaggagaucaagauuacuccccaaucaagcaucaccgaagccgagcugacaggauacggcaccguuacgauggaaugcaguccucggacugguuuggacuuuaacgagauggugcuccugcagauggagaauaaggcuuggcugguccaucgccagugguuccucgauuuaccacugcccuggcuuccuggggcagacacacagggauccaacuggauucaaaaggaaaccuuggugacuuuuaaaaauccacacgccaagaaacaggauguggucguucugggcucucaggagggcgcuaugcacacagcccuaaccggggcgacggaaauccagaugagcuccggaaaccuccuguucaccggucaucuuaaguguagacugaggauggacaaauugcaacucaagggcaugucauauaguaugugcacagggaaguuuaaagugguaaaggagauagcagaaacucagcacggaaccauugugauccggguccaguacgagggcgaugguagcccguguaaaauucccuucgagaucauggaccuggaaaagcgccauguguuagggcgacugaucacaguuaauccuauugugacugagaaagauucuccagucaacauagaagccgagcccccuuuuggcgacuccuauaucauuaucggaguggaaccaggccaacucaaacuuaauugguucaagaaagggucaagcauaggacagauguucgagaccacaaugagaggugcuaagaggauggccauucugggcgacaccgcaugggauuuugggaguuga

SEQ ID NO: 1775 - RNA, 2379 nt, Artificial Sequence
  derived and/or modified CDS sequence (opt3) from DENV-2 CYD2-T__C-P2A-SSc-prME
augaacaaucagagaaagaaagccaagaacacccccuucaauaugcugaaaagggagcggaaccgcgugagcacaguccaacagcucacuaagcgauuuucccuuggcaugcugcaggggcguggaccuuugaaauuauucauggcucugguugcauuucuaagauuccucacgaucccaccgaccgccgguauucugaagagguggggcacaauaaagaaaucuaaggcgaucaaugugcuucggggguuucgcaaagaaauuggaagaaugcugaacaucuugaauaggcggcgccgaaacuucgaccuccugaagcuggcuggcgauguagagucaaaucccgguccuagugccgggaugauuaucaugcucauaccaacugugauggcauuucacuuaaccacaagaaacggagaaccccauaugaucgucagcaggcaggagaaaggcaagucccugcuuuucaagaccgaagacggcgugaauaugugcacuuugauggccauggaucugggggagcuaugugaggacacaauuaccuacaaaugcccucuccugcggcaaaacgaaccagaggauaucgacuguuggugcaauucuacgucgacuuggguuaccuauggaacauguacuaccaugggugaacaccgucgcgagaagagaucaguggcucuugucccccaugugggcauggggcuggagacaaggaccgaaacguggaugagcagugagggagcauggaaacacguacagcggauugaaacuuggaucuugcgacauccuggcuuuacaaugauggccgcuauacucgccuacaccauugguacuacacacuuccagcgcgcgcugaucuuuauuuuacugaccgcaguuacgccauccaugaccaugagaugcaucgggaugucuaacagggauuucguggagggagucagcggcggcuccuggguggacaucgugcucgaacacgggucaugugucacaacuauggccaagaauaaaccgacccuugauuuugagcugauuaagacagaggcuaaacagcccgccacuuugcggaaguauugcauagaagcaaagcuaaccaacacaaccacugagagucgcuguccuacgcaaggagaaccaagccugaacgaggaacaggacaaaagauucguuugcaagcauucuaugguggauagggguuggggcaauggguguggacucuucggcaaaggugggaucguaacaugcgcuauguuucguugcaagaaaaacauggagggcaaggugguccagcccgagaaucuggaauacaccauugugaucacuccucacuccggagaggaacaugccguuggcaacgacaccgggaagcacggaaaagagauaaagauuacaccacagucaagcaucaccgaagcggagcuuacugguuauggcacagugacgauggaguguaguccccggaccgggcuggauuucaaugaaauggucuugcuccaaauggagaacaaagccuggcuggugcaccgacagugguuuuuagaccugccgcuaccuuggcuccccggagcagacacucagggcucuaauuggauccaaaaggaaacacugguaaccuucaaaaacccacaugcuaagaagcaggauguugugguccuugguucccaggagggggccaugcacacagcuuugacuggcgccaccgagauucagaugagcucgggaaaucugcucuuuacgggccaucugaaaugcagacuuaggauggacaagcugcaauugaaagggaugucuuacuccauguguaccggaaaguucaaaguggucaaggaaaucgcagagacacagcacgguacuauugugauacgcguucaguaugaaggcgaugggucaccuugcaagauccccuuugagauuauggaccucgaaaaacggcaugugcugggaagauuaaucaccguaaacccaaucgucacagagaaggauagucccgugaauauugaggccgaaccuccauucggcgacagcuacauaaucauugguguugagccggggcagcugaaacuaaacugguuuaagaaaggcuccucuaucggacaaauguucgaaacuaccaugaggggcgcuaagcgcauggcgauucucggggauacggcaugggacuuuggaagccugggcgguguguucacaucaaucgggaaagcccuucaccaggucuuuggagcuauauacggcgccgcauucagugguguguccuggaccaugaagaucuugauuggcguaaucauuacuuggaucgggaugaauagccgaucuacaucacugagugugacccucguucuggucggaauagugacuuuauaucugggcgugaugguccaggccuga

SEQ ID NO: 1776 - RNA, 2043 nt, Artificial Sequence
  derived and/or modified CDS sequence (opt3) from DENV-2 CYD2-T__SSopt-prME(F108S)
augaagcguaaaaagagcgccggcaugaucauuaugcugauacccaccgugauggcuuuccaccucacaacuaggaauggggagccucauaugaucgucucccggcaggaaaaaggaaagucucuucuguuuaaaacggaggacgguguuaauaugugcaccuugauggcaauggauuuaggcgaacugugugaggacacaauuacuuacaagugcccacuacuccgccaaaacgaaccggaggauaucgacuguuggugcaauucaaccaguacaugggugaccuaugggacuuguacaaccaugggagagcaccgacgugaaaagagaagcguagcccuggugccccaugucggcaugggucuugagacgaggacugaaaccuggauguccucugagggggcguggaaacacgugcagcggauugagacauggauccugcgccauccuggauucacuaugauggcugccauauuggcauacaccaucggcacaacccacuuucagagagcccucauuuucauccugcugacggcuguuacuccaucgaugacaaugaggugcauuggcaugucaaaccgggauuuuguggaaggggucagcggagguaguuggguggacaucguacucgagcacggcuccuguguuaccacuauggcaaagaauaaacccacauuagauuucgaacugauaaagaccgaggccaaacagccugcuacgcuucgcaaguauugcauugaagccaaguugaccaacacaacuaccgagucucgauguccaacacaaggggagcccagccugaaugaggaacaggacaaaagauuugugugcaagcauuccauggucgauaggggauggggcaacgguugugggcuaucaggaaaaggcggcaucgugacuugcgcgauguuccggugcaagaaaaauauggaagggaaggugguccagccugagaaccucgaauacaccauuguuaucacaccacacaguggagaggagcaugcaguggguaaugacaccggcaaacacgggaaggaaaucaagauuacuccgcagagcucuauaacggaggccgaacugacaggauauggcaccguaacuauggaguguucccccagaaccggucuugauuuuaacgaaauggugcuguugcaaauggagaauaaggcuuggcucguccaccgccagugguuccuggacuuaccucugccauggcuccccggggccgauacacagggcucaaacuggauccagaaggagacccuugugacuuuuaaaaauccucaugcaaagaaacaagacguugugguccugggaagccaggaaggcgcuaugcacacagccuugacgggggcgaccgagauucagaugaguucuggaaaccuacuguucacuggucaucucaagugcagacugaggauggacaaacuucaacugaaaggcauguccuacagcauguguacagggaaguuuaaagugguaaaggaaaucgccgagacccagcacggaacaauaguuauucgggugcaguaugagggcgaugguucgccaugcaaaauccccuucgaaaucauggacuuggagaagcgacauguccucgggcgccugauuacugugaacccgaucgucaccgaaaaggauucuccugugaauauugaggcagaacccccauucggcgacuccuacauaaucauuggaguugagccuggccaguuaaaacugaacugguuuaagaaagggucaaguaucggacaaauguucgagacgaccaugagaggugcuaagaggauggccauccuaggcgauacagcuugggacuuugggagccucggaggcguguucacuuccauugguaaagcccugcaccagguauuuggggcaauauacggcgccgcuuucucuggagucagcuggaccaugaagauccuuauuggcgugaucauuacauggaucgggaugaacucacggaguacuuccuugagcguuacccuggugcucgucggaauagugacgcuguaucuuggcguaauggugcaggcguga

SEQ ID NO: 1777 - RNA, 2043 nt, Artificial Sequence
  derived and/or modified CDS sequence (opt3) from DENV-2 CYD2-T__SSopt-prME(M96H)
augaagaggaaaaagagcgccggcaugaucauuaugcugauacccaccgugauggcuuuccaccucacaacuagaaacggggagccucauaugaucgucucccggcaggaaaaaggaaagucucuucuguuuaaaacggaggacgguguuaauaugugcaccuugauggcaauggauuuaggcgaacugugugaggacacaauuacuuacaagugcccacuacuccgccaaaacgaaccggaggauaucgacuguuggugcaauucaaccaguacaugggugaccuaugggacuuguacaaccaugggagagcaccgacgugaaaagagaagcguagcccuggugccccaugucggcaugggucuugagacgaggacugaaaccuggauguccucugagggggcguggaaacacgugcagcggauugagacauggauccugcgccauccuggauucacuaugauggcugccauauuggcauacaccaucggcacaacccacuuucagagagcccucauuuucauccugcugacggcuguuacuccaucgaugacaaugaggugcauuggcaugucaaaccgggauuuuguggaaggggucagcggagguaguuggguggacaucguacucgagcacggcuccuguguuaccacuauggcaaagaauaaacccacauuagauuucgaacugauaaagaccgaggccaaacagccugcuacgcuucgcaaguauugcauugaagccaaguugaccaacacaacuaccgagucucgauguccaacacaaggggagcccagccugaaugaggaacaggacaaaagauuugugugcaagcauucccacgucgauaggggauggggcaacgguugugggcuauucggaaaaggcggcaucgugacuugcgcgauguuucggugcaagaaaaauauggaagggaaggugguccagccugagaaccucgaauacaccauuguuaucacaccacauucaggagaggagcacgcaguggguaaugacaccggcaaacacgggaaggaaaucaagauuacuccgcagaguagcauaacggaggccgaacugacaggauauggcaccguaacuauggaguguucuccccguaccggucuugauuucaacgaaauggugcuguugcaaauggagaauaaggcuuggcucguccaucgccagugguuucuggacuuaccucugccauggcuccccggggccgauacacagggcuccaacuggauccagaaggagacccuugugacuuucaaaaauccucacgcaaagaaacaagacguugugguccugggaucacaggaaggcgcuaugcauacagccuugacgggggcgaccgagauucagaugagcaguggaaaccuacuguuuacuggucaccucaagugcagacugaggauggacaaacuucaacugaaaggcaugucuuacuccauguguacagggaaguucaaagugguaaaggaaaucgccgagacccagcauggaacaauaguuauucgggugcaguaugagggcgaugguagcccaugcaaaauccccuucgaaaucauggacuuggagaagcgacacguccucgggcgccugauuacugugaacccgaucgucaccgaaaaggauucgccugugaauauugaggcagaacccccauuuggcgacucuuacauaaucauuggaguugagccuggccaguuaaaacugaacugguucaagaaaggguccucaaucggacaaauguuugagacgaccaugagaggugcuaagaggauggccauccuaggcgauacagcuugggacuucgggagucucggaggcguguuuacuagcauugguaaagcccugcaccagguauucggggcaauauacggcgccgcuuuuuccggagucucuuggaccaugaagauccuuauuggcgugaucauuacauggaucgggaugaauagccggucaaccaguuuguccguuacucuggugcucgucggaauagugacgcuguaucuuggcguaauggugcaggcguga

SEQ ID NO: 1778 - RNA, 2043 nt, Artificial Sequence
  derived and/or modified CDS sequence (opt3) from DENV-2 CYD2-T__SSopt-prME(S186F)
augaagaggaaaaagagcgccggcaugaucauuaugcugauacccaccgugauggcuuuccaccucacaacuagaaacggggagccucauaugaucgucucccggcaggaaaaaggaaagucucuucuguuuaaaacggaggacgguguuaauaugugcaccuugauggcaauggauuuaggcgaacugugugaggacacaauuacuuacaagugcccacuacuccgccaaaacgaaccggaggauaucgacuguuggugcaauucaaccaguacaugggugaccuaugggacuuguacaaccaugggagagcaccgacgugaaaagagaagcguagcccuggugccccaugucggcaugggucuugagacgaggacugaaaccuggauguccucugagggggcguggaaacacgugcagcggauugagacauggauccugcgccauccuggauucacuaugauggcugccauauuggcauacaccaucggcacaacccacuuucagagagcccucauuuucauccugcugacggcuguuacuccaucgaugacaaugaggugcauuggcaugucaaaccgggauuuuguggaaggggucagcggagguaguuggguggacaucguacucgagcacggcuccuguguuaccacuauggcaaagaauaaacccacauuagauuucgaacugauaaagaccgaggccaaacagccugcuacgcuucgcaaguauugcauugaagccaaguugaccaacacaacuaccgagucucgauguccaacacaaggggagcccagccugaaugaggaacaggacaaaagauuugugugcaagcauuccauggucgauaggggauggggcaacgguugugggcuauucggaaaaggcggcaucgugacuugcgcgauguuucggugcaagaaaaauauggaagggaaggugguccagccugagaaccucgaauacaccauuguuaucacaccacacucaggagaggagcaugcaguggguaaugacaccggcaaacacgggaaggaaaucaagauuacuccgcagaguagcauaacggaggccgaacugacaggauauggcaccguaacuauggaguguuucccccguaccggucuugauuuuaacgaaauggugcuguugcaaauggagaauaaggcuuggcucguccaccgccagugguuccuggacuuaccucugccauggcuccccggggccgauacacagggcucuaacuggauccagaaggagacccuugugacuuuuaaaaauccucaugcaaagaaacaagacguugugguccugggaucccaggaaggcgcuaugcacacagccuugacgggggcgaccgagauucagaugucaagcggaaaccuacuguucacuggucaucucaagugcagacugaggauggacaaacuucaacugaaaggcaugaguuacucuauguguacagggaaguucaaagugguaaaggaaaucgccgagacccagcacggaacaauaguuauucgggugcaguaugagggcgaugguuccccaugcaaaauccccuuugaaaucauggacuuggagaagcgacauguccucgggcgccugauuacugugaacccgaucgucaccgaaaaggauagcccugugaauauugaggcagaacccccauucggcgacucguacauaaucauuggaguugagccuggccaguuaaaacugaacugguuuaagaaagggucuuccaucggacaaauguucgagacgaccaugagaggugcuaagaggauggccauccuaggcgauacagcuugggacuuugggucacucggaggcguguucacuucuauugguaaagcccugcaccagguauuuggggcaauauacggcgccgcuuucagcggagucuccuggaccaugaagauccuuauuggcgugaucauuacauggaucgggaugaauagucggagcacuucauugaguguuacccuggugcucgucggaauagugacgcuguaucuuggcguaauggugcaggcguga

SEQ ID NO: 1779 - RNA, 2043 nt, Artificial Sequence
  derived and/or modified CDS sequence (opt3) from DENV-2 CYD2-T__SSopt-prME(R188L)
augaagaggaaaaagagcgccggcaugaucauuaugcugauacccaccgugauggcuuuccaccucacaacuagaaacggggagccucauaugaucgucucccggcaggaaaaaggaaagucucuucuguuuaaaacggaggacgguguuaauaugugcaccuugauggcaauggauuuaggcgaacugugugaggacacaauuacuuacaagugcccacuacuccgccaaaacgaaccggaggauaucgacuguuggugcaauucaaccaguacaugggugaccuaugggacuuguacaaccaugggagagcaccgacgugaaaagagaagcguagcccuggugccccaugucggcaugggucuugagacgaggacugaaaccuggauguccucugagggggcguggaaacacgugcagcggauugagacauggauccugcgccauccuggauucacuaugauggcugccauauuggcauacaccaucggcacaacccacuuucagagagcccucauuuucauccugcugacggcuguuacuccaucgaugacaaugaggugcauuggcaugucaaaccgggauuuuguggaaggggucagcggagguaguuggguggacaucguacucgagcacggcuccuguguuaccacuauggcaaagaauaaacccacauuagauuucgaacugauaaagaccgaggccaaacagccugcuacgcuucgcaaguauugcauugaagccaaguugaccaacacaacuaccgagucucgauguccaacacaaggggagcccagccugaaugaggaacaggacaaaagauuugugugcaagcauuccauggucgauaggggauggggcaacgguugugggcuauucggaaaaggcggcaucgugacuugcgcgauguuucggugcaagaaaaauauggaagggaaggugguccagccugagaaccucgaauacaccauuguuaucacaccacacucaggagaggagcaugcaguggguaaugacaccggcaaacacgggaaggaaaucaagauuacuccgcagaguagcauaacggaggccgaacugacaggauauggcaccguaacuauggaguguucuccccuuaccggucuggauuucaacgaaaugguguugcuccaaauggagaauaaggcuuggcugguccaccgucagugguuuuuagaccugccucucccauggcuucccggggccgauacacagggcuccaacuggauccagaaagagacccuggugacuuucaaaaauccucaugcaaagaaacaagacguuguggucuugggaucacaggaaggcgcuaugcacacagcccuaacgggggcgaccgagauucagaugagcaguggaaaccugcucuuuacuggucaucugaagugccgccuuagaauggacaagcugcaauugaaaggcaugucuuacuccauguguacagggaaguucaaagugguaaaggaaaucgccgagacccagcacggaacaauaguuauuagggugcaguaugagggcgaugguagcccaugcaaaauccccuucgaaaucauggaccucgagaagcggcauguccuggggcgauuaauuacugugaacccgaucgucaccgaaaaggauucgccugugaauauugaggcagaacccccauuuggcgacucuuacauaaucauuggaguugagccuggccagcugaaacuaaacugguucaagaaaggguccucaaucggacaaauguuugagacgaccaugcgcggugcuaagagaauggccauccucggcgauacagcuugggacuucgggagucugggaggcguguuuacuagcauugguaaagcccuucaccagguauucggggcaauauacggcgccgcuuuuuccggagucucuuggaccaugaagaucuugauuggcgugaucauuacauggaucgggaugaauagcaggucaaccagucuguccguuacucucgugcuggucggaauagugacgcuuuaucugggcguaauggugcaggcguga

SEQ ID NO: 1780 - RNA, 2043 nt, Artificial Sequence
  derived and/or modified CDS sequence (opt3) from DENV-2 CYD2-T__SSopt-pr(D104A)MEdelstem_TM,(F108S)-JEV
augaagcguaaaaagagcgccggcaugaucauuaugcugauacccaccgugauggcuuuccaccucacaacuaggaacggggagccucauaugaucgucucccggcaggaaaaaggaaagucucuucuguuuaaaacggaggacgguguuaauaugugcaccuugauggcaauggauuuaggcgaacugugugaggacacaauuacuuacaagugcccacuacuccgccaaaacgaaccggaggauaucgacuguuggugcaauucaaccaguacaugggugaccuaugggacuuguacaaccaugggagagcaccgacgugccaagagaagcguagcgcuggugccccaugucggcaugggucuugaaacgaggacugagaccuggauguccucugaaggggcuuggaaacacgugcagcggauugagacauggauccugcgccauccuggauucacuaugauggccgcaauauuggccuacaccaucggcacaacccacuuucagagagcucucauuuucauccugcugacggcaguuacuccaucgaugacaaugaggugcauuggcaugucaaaccgggauuuuguggagggggucagcggagguaguuggguggacaucguacucgaacacggcuccuguguuaccacuauggccaagaauaaacccacauuagauuucgagcugauaaagaccgaagcuaaacagccugccacgcuucgcaaguauugcauugaggcgaaguugaccaacacaacuaccgaaucucgauguccaacacaaggggagcccagccugaaugaggaacaggacaaaagauuugugugcaagcauuccauggucgauaggggauggggcaacgguugugggcuaucaggaaaaggcggcaucgugacuugcgcaauguuccggugcaagaaaaauauggaggggaaggugguccagccugaaaaccucgaguacaccauuguuaucacaccacacaguggagaggaacaugccguggguaaugacaccggcaaacacgggaaggagaucaagauuacuccgcagagcucuauaacggaagcugagcugacaggauauggcaccguaacuauggaauguucccccagaaccggucuugauuuuaacgagauggugcuguugcaaauggaaaauaaagccuggcucguccaccgccagugguuccuggacuuaccucugccauggcuccccggggcagauacacagggcucaaacuggauccagaaggagacccuugugacuuuuaaaaauccucaugcuaagaaacaagacguugugguccugggaagccaggagggcgccaugcacacagcguugacgggggccaccgaaauucagaugaguucuggaaaccuacuguucacuggucaucucaagugcagacugaggauggacaaacuucaacugaagggcauguccuacagcauguguacagggaaguuuaaagugguaaaggagaucgcagaaacccagcacggaacaauaguuauucgggugcaguaugagggcgaugguucgccaugcaaaauccccuucgagaucauggacuuggaaaagcgacauguccucgggcgccugauuacugugaacccgaucgucaccgagaaggauucuccugugaauauugaagcugagcccccauucggcgacuccuacauaaucauuggaguugaaccuggccaguuaaaacugaacugguuuaagaaagggucaacgcuaggaaaggccuucaguaccacacucaaaggugcucaaagacuggccgcacuuggcgauacugccugggacuuugggagcaucggaggcguguucaauuccaucgguagggcuguacaccaggucuuugggggcgcguuccggaccuuguuuggaggcaugucuuggauuacacaggggcugaugggagcacuccugcuuuggaugggcgugaacgcccgcgauagaagcauagcucuggccuucuuggcaacuggugggguucucguguuucuggccaccaauguccacgcuuga

SEQ ID NO: 1781 - RNA, 2043 nt, Artificial Sequence
  derived and/or modified CDS sequence (opt3) from DENV-2 CYD2-T__SSopt-prMEdelstem_TM,(H261N)-JEV
augaagaggaaaaagagcgccggcaugaucauuaugcugauacccaccgugauggcuuuccaccucacaacuagaaacggggagccucauaugaucgucucccggcaggaaaaaggaaagucucuucuguuuaaaacggaggacgguguuaauaugugcaccuugauggcaauggauuuaggcgaacugugugaggacacaauuacuuacaagugcccacuacuccgccaaaacgaaccggaggauaucgacuguuggugcaauucaaccaguacaugggugaccuaugggacuuguacaaccaugggagagcaccgacgugaaaagagaagcguagcccuggugccccaugucggcaugggucuugagacgaggacugaaaccuggauguccucugagggggcguggaaacacgugcagcggauugagacauggauccugcgccauccuggauucacuaugauggcugccauauuggcauacaccaucggcacaacccacuuucagagagcccucauuuucauccugcugacggcuguuacuccaucgaugacaaugaggugcauuggcaugucaaaccgggauuuuguggaaggggucagcggagguaguuggguggacaucguacucgagcacggcuccuguguuaccacuauggcaaagaauaaacccacauuagauuucgaacugauaaagaccgaggccaaacagccugcuacgcuucgcaaguauugcauugaagccaaguugaccaacacaacuaccgagucucgauguccaacacaaggggagcccagccugaaugaggaacaggacaaaagauuugugugcaagcauuccauggucgauaggggauggggcaacgguugugggcuauucggaaaaggcggcaucgugacuugcgcgauguuucggugcaagaaaaauauggaagggaaggugguccagccugagaaccucgaauacaccauuguuaucacaccacacucaggagaggagcaugcaguggguaaugacaccggcaaacacgggaaggaaaucaagauuacuccgcagaguagcauaacggaggccgaacugacaggauauggcaccguaacuauggaguguucuccccguaccggucuugauuucaacgaaauggugcuguugcaaauggagaauaaggcuuggcucguccaccgccagugguuucuggacuuaccucugccauggcuccccggggccgauacacagggcuccaacuggauccagaaggagacccuugugacuuucaaaaauccucaugcaaagaaacaagacguugugguccugggaucacaggaaggcgcuaugaacacagccuugacgggggcgaccgagauucagaugagcaguggaaaccuacuguuuacuggucaccucaagugcagacugaggauggacaaacuucaacugaaaggcaugucuuacuccauguguacagggaaguucaaagugguaaaggaaaucgccgagacccagcauggaacaauaguuauucgggugcaguaugagggcgaugguagcccaugcaaaauccccuucgaaaucauggacuuggagaagcgacacguccucgggcgccugauuacugugaauccgaucgucaccgaaaaggauucgccugugaacauugaggcagaacccccauuuggcgacucuuacauaaucauuggaguugagccuggccaguuaaaacugaauugguucaagaaaggguccacgcuaggaaaggcuuuuucaaccacacucaaaggugcccaaagacuggcugcccuuggcgauacugcaugggacuucgggaguaucggaggcguguuuaacagcaucgguagggccguacaucaggucuucgggggcgcuuuucggaccuuguucggaggcauguccuggauuacacaggggcugaugggagcgcuccugcuuuggaugggcgugaaugcacgcgauagaucuauagcccuggccuuuuuggcuacuggugggguucucguguuccuggcaaccaacguccacgccuga

SEQ ID NO: 1782 - RNA, 2043 nt, Artificial Sequence
  derived and/or modified CDS sequence (opt3) from DENV-2 CYD2-T__SSopt-prMEdelstem_TM,(R188L,A267T)-JEV
augaagaggaaaaagagcgccggcaugaucauuaugcugauacccaccgugauggcuuuccaccucacaacuagaaacggggagccucauaugaucgucucccggcaggaaaaaggaaagucucuucuguuuaaaacggaggacgguguuaauaugugcaccuugauggcaauggauuuaggcgaacugugugaggacacaauuacuuacaagugcccacuacuccgccaaaacgaaccggaggauaucgacuguuggugcaauucaaccaguacaugggugaccuaugggacuuguacaaccaugggagagcaccgacgugaaaagagaagcguagcccuggugccccaugucggcaugggucuugagacgaggacugaaaccuggauguccucugagggggcguggaaacacgugcagcggauugagacauggauccugcgccauccuggauucacuaugauggcugccauauuggcauacaccaucggcacaacccacuuucagagagcccucauuuucauccugcugacggcuguuacuccaucgaugacaaugaggugcauuggcaugucaaaccgggauuuuguggaaggggucagcggagguaguuggguggacaucguacucgagcacggcuccuguguuaccacuauggcaaagaauaaacccacauuagauuucgaacugauaaagaccgaggccaaacagccugcuacgcuucgcaaguauugcauugaagccaaguugaccaacacaacuaccgagucucgauguccaacacaaggggagcccagccugaaugaggaacaggacaaaagauuugugugcaagcauuccauggucgauaggggauggggcaacgguugugggcuauucggaaaaggcggcaucgugacuugcgcgauguuucggugcaagaaaaauauggaagggaaggugguccagccugagaaccucgaauacaccauuguuaucacaccacacucaggagaggagcaugcaguggguaaugacaccggcaaacacgggaaggaaaucaagauuacuccgcagaguagcauaacggaggccgaacugacaggauauggcaccguaacuauggaguguucuccccuuaccggucuggauuucaacgaaaugguguugcuccaaauggagaauaaggcuuggcugguccaccgucagugguuuuuagaccugccucucccauggcuucccggggccgauacacagggcuccaacuggauccagaaagagacccuggugacuuucaaaaauccucaugcaaagaaacaagacguuguggucuugggaucacaggaaggcgcuaugcacacagcccuaacggggaccacugagauucagaugagcaguggaaaccugcucuuuacaggucaucugaagugccgccuuagaauggacaagcugcaauugaaaggcaugucuuacuccauguguaccgggaaguucaaagugguaaaggaaaucgcggagacacagcacggaacuauaguuauuagggugcaguaugagggcgaugguagcccaugcaaaauccccuucgaaaucauggaccucgagaagcggcauguccuggggcgauuaauuaccgugaacccgaucgucacggaaaaggauucgccugugaauauugaggccgaacccccauuuggcgacucuuacauaaucauuggaguugagccuggccagcugaaacuaaacugguucaagaaaggguccacccucggaaaggcauuuucaacaacucugaaaggugcucaacgccuugccgcuuugggcgauaccgccugggacuucgggaguaucggaggcguguuuaauagcaucgguagagcaguacaccaggucuucgggggcgccuuuaggacacuguucggaggcauguccuggauuacucaggggcucaugggagcucugcuucuguggaugggcgugaacgcgcgggaucgcucuauagcauuggccuuucucgcuaccggugggguucugguguucuuagccacgaauguccacgcauga

SEQ ID NO: 1783 - RNA, 297 nt, Artificial Sequence
  derived and/or modified CDS sequence (opt3) from DENV-4 Consensus__C
augaaccagagaaagaaaguggucaggcccccuuucaauaugcugaagcgggagcgcaaccgaguuagcaccccacaaggccucgugaaacguuuuuccacagggcuuuucucuggaaaggguccgcugagaaugguauuggccuuuaucacuuucuuaagggugcugucaauucccccuacggcuggcauacuaaaacggugggggcagcucaagaagaauaaagcaaucaagauucugaucggauuucgcaaagaaauuggcagaaugcuuaacauccugaaugguaggaagcgg

SEQ ID NO: 1784 - RNA, 339 nt, Artificial Sequence
  derived and/or modified CDS sequence (opt3) from DENV-4 Consensus__C-SSc
augaaccagagaaagaaaguggucaggcccccuuucaauaugcugaagcgggagcgcaaccgaguuagcaccccacaaggccucgugaaacguuuuuccacagggcuuuucucuggaaaggguccgcugagaaugguauuggccuuuaucacuuucuuaagggugcugucaauucccccuacggcuggcauacuaaaacggugggggcagcucaagaagaauaaagcaaucaagauucugaucggauuucgcaaagaaauuggcagaaugcuuaacauccugaaugguaggaagcggaguaccauaacauugcucugccugaucccaacugucauggcc

SEQ ID NO: 1785 - RNA, 273 nt, Artificial Sequence
  derived and/or modified CDS sequence (opt3) from DENV-4 Consensus__pr
uuccaccugagcaccagagacggcgagccccucaugaucguggccaagcaugaaagggggcggccucuucuguuuaaaacaacugagggaauuaacaagugcacguugauagcuauggauuuaggugaaaugugugaggacaccgucacauacaaaugcccacugcuaguuaauacugaaccggaggauaucgacuguuggugcaaccucaccuccacaugggugauguauggcaccuguacucagucuggggagcgccgacgugaaaagaga

SEQ ID NO: 1786 - RNA, 225 nt, Artificial Sequence
  derived and/or modified CDS sequence (opt3) from DENV-4 Consensus__M
agcguggcccugacaccccacuccggcauggggcucgagaccagagcugaaacuuggaugucuucagagggagcauggaagcaugcccagagggucgaaaguuggauccuucggaacccugguuucgcgcuguuggcuggcuuuauggccuacaugauugggcaaacgggaauacagcgcaccguuuucuuuguguuaaugaugcugguagcaccaagcuauggc

SEQ ID NO: 1787 - RNA, 498 nt, Artificial Sequence
  derived and/or modified CDS sequence (opt3) from DENV-4 Consensus__prM
uuccaccugagcaccagagacggcgagccccucaugaucguggccaagcaugaaagggggcggccucuucuguuuaaaacaacugagggaauuaacaagugcacguugauagcuauggauuuaggugaaaugugugaggacaccgucacauacaaaugcccacugcuaguuaauacugaaccggaggauaucgacuguuggugcaaccucaccuccacaugggugauguauggcaccuguacucagucuggggagcgccgacgugaaaagagaucaguagcacugacaccccacaguggaaugggccuugagaccagggccgaaacguggaugagcuccgagggugcguggaaacaugcucaacggguggagucuuggauucugcgcaauccuggguucgccuugcucgcaggauuuauggccuacaugaucggccagacuggcauucagagaaccgucuucuuugugcugaugaugcugguugcuccaucguauggg

SEQ ID NO: 1788 - RNA, 1485 nt, Artificial Sequence
  derived and/or modified CDS sequence (opt3) from DENV-4 Consensus__E
augagaugcgugggcgucgggaacagggacuucguugagggagugagcgguggcgccuggguagaucuggugcucgaacacgggggaugugucaccacaauggcucagggcaagcccacucuugacuuugagcugacgaaaaccacagcaaaggaaguggccuuguuacggacuuacugcaucgaggcguccauuucuaauauaaccacagcuacccgcuguccuacucaaggugaaccauaucugaaagaggagcaggaucagcaguacaucugccgacgugacguuguggauagaggguggggaaacggcuguggccuauucgggaagggaggugucgugacaugcgccaaauuuucauguaguggcaagauuaccgggaaucucguacaaaucgaaaaccuggaguauacgguuguggucacugugcauaauggagacacccacgcagugggcaacgauacaagcaaucauggugucacugccaccauuacaccgaggucccccucuguugaagugaaacuuccugacuacggggagcugaccuuggauugcgagccacggucgggaaucgacuucaacgaaaugauacucaugaagaugaagaaaaagacguggcugguacacaaacagugguuucuggaucuccccuuaccuuggacugcuggcgcagacacaucagaggugcauuggaauuauaaggaacgcauggucaccuucaaggugccacacgccaaaagacaggauguuacugugcugggcagccaggagggggcuaugcacagugcccuugcgggagcaacagaagucgacuccggugacggcaaccauauguuugccgggcacuugaaguguaaagugaggauggagaagcugcggaucaaaggaaugucuuacaccaugugcagcggcaaguucuccauugauaaagagauggcugaaacgcaacaugguaccacaguaguuaaggugaaguaugagggggccggcgcacccuguaaagucccuaucgaaauucgcgacgugaauaaggagaaagucgugggacgaguuaucucaaguacuccacuagcugaaaacaccaauagcgugacaaacauagagcucgagccgcccuuuggcgauucuuacauuguaaucggggucggaaauuccgcccugacucuucacugguucagaaaggguucaagcauuggcaaaauguuugaaaguaccuacaggggagcgaagcggauggccauccugggggagacagcaugggacuucggcucuguggguggguuguuuaccucccucggcaaggcuguucaccagguguucggaagcgucuauacuacgauguucggcggggugucguggaugauccguauucugauaggauuuuuaguacuguggaucgguacaaacucucgcaacaccuccauggccaugacuugcauugcugugggcgggaucacccucuuccuuggauuuacaguucaggcc

SEQ ID NO: 1789 - RNA, 1983 nt, Artificial Sequence
  derived and/or modified CDS sequence (opt3) from DENV-4 Consensus__prME
uuccaccugagcaccagagacggcgagccccucaugaucguggccaagcaugaaagggggcggccucuucuguuuaaaacaacugagggaauuaacaagugcacguugauagcuauggauuuaggugaaaugugugaggacaccgucacauacaaaugcccacugcuaguuaauacugaaccggaggauaucgacuguuggugcaaccucaccuccacaugggugauguauggcaccuguacucagucuggggagcgccgacgugaaaagagaucaguagcacugacaccccacaguggaaugggccuugagaccagggccgaaacguggaugagcuccgagggugcguggaaacaugcucaacggguggagucuuggauucugcgcaauccuggguucgccuugcucgcaggauuuauggccuacaugaucggccagacuggcauucagagaaccgucuucuuugugcugaugaugcugguugcuccaucguaugggaugaggugcgugggagucgguaaccgggauuucguggaaggcguaucagggggagcauggguugaccucguguuagagcacggcgguugugucacaacuauggcccaggggaagcccacccuggauuuugaacuuacaaagaccacggcuaaagagguggccuugcugcgcacuuacugcaucgaagcgagcauaaguaauaucacaaccgcaacucgauguccuacacaaggagagccauaucuaaaggaggaacaggaccagcaguacauuugcagaagggauguggucgaccggggcuggggcaacggguguggacucuucgguaaaggcgggguugugaccugcgccaaguuuuccugcucuggaaaaaucacgggcaaucugguacaaauugagaaccuugaauauaccguggucgugacaguucauaauggugauacucacgcuguggggaacgacaccagcaaucacggcgucacagccacuaucacaccccguuccccuucaguggagguaaagcugccagauuacggagaauugacccucgacugugagccgcgcaguggcauagacuucaacgagaugauucugaugaagaugaaaaagaaaaccugguuaguucauaagcagugguuucuggaucucccccuuccuuggacugcaggggcugacacgagcgaagugcacuggaauuacaaagagagaauggucacauucaaggugccacaugccaaaaggcaggaugucaccgugcugggaucucaggaaggugcgaugcacuccgccuuggcaggcgcuacugagguugacucaggggauggaaaccacauguuugccggccaucuaaagugcaaggugcggauggaaaaacugcgaaucaaggguaugagcuauaccauguguagugggaaauucucuauugacaaggagauggcugagacacaacacggcaccacuguagucaaagugaaguacgaaggagccggcgcacccugcaagguuccuaucgagauccgcgaugugaauaaagaaaaggucguggggagaguaauuuccagcacaccacucgccgagaacacgaacucggugaccaauauagagcuggaacccccguucggagacucuuauaucguuauuggugucggcaacuccgcucuuacucugcauugguuuaggaaagggucaaguaucggaaagauguucgagagcacauaccggggcgcgaaacgcauggcaauauugggugaaaccgccugggauuuuggguccgugggcggacucuucacaucucugggcaaggcugugcaccaggucuuugggagcguuuauacuaccauguucggaggcgugucauggaugauuagaaucuuaaucgguuuucuggugcuauggauugggacgaauaguaggaacaccuccauggccaugacauguaucgcaguaggaggcauuacucucuuccuggguuuuaccguccaggcc

SEQ ID NO: 1790 - RNA, 2025 nt, Artificial Sequence
  derived and/or modified CDS sequence (opt3) from DENV-4 Consensus__SSc-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguaugggaccugcacgcagucaggcgagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguagcauuggaaagauguucgaguccacuuaccggggcgcaaaacgcauggccaucuuaggugaaaccgcuugggauuuugggucugugggcggacuguucacgagccuaggcaaggccguccaccagguuuuugggucaguguauaccacaauguucggaggcgugaguuggaugaucaggauucucaucgguuuucugguacuuuggauugggacuaauuccagaaacaccagcauggcaaugacaugcauagccgucggaggcaucacuuuguuccuggguuuuaccgugcaggcu

SEQ ID NO: 1791 - RNA, 2322 nt, Artificial Sequence
  derived and/or modified CDS sequence (opt3) from DENV-4 Consensus__C-prME
augaaccagagaaagaaaguggucaggcccccuuucaauaugcugaagcgggagcgcaaccgaguuagcaccccacaaggccucgugaaacguuuuuccacagggcuuuucucuggaaaggguccgcugagaaugguauuggccuuuaucacuuucuuaagggugcugucaauucccccuacggcuggcauacuaaaacggugggggcagcucaagaagaauaaagcaaucaagauucugaucggauuucgcaaagaaauuggcagaaugcuuaacauccugaaugguaggaagcggaguaccauaacauugcucugccugaucccaacugucauggccuuccaccugagcacccgcgacggggagccccucaugauuguggcgaaacaugaacgaggaagaccuuuacuguuuaagacaaccgagggcaucaacaaguguacucuuauugcuauggauuugggcgaaaugugcgaggacacaguuaccuacaaauguccacugcuagugaauacggagcccgaagauaucgacugcugguguaaccucacuuccaccugggucauguaugggacaugcacucagucuggagagaggcggcgugaaaagcgcucgguggcccugaccccucacucagguaugggccuugagacaagagcagagaccuggaugagcagugaaggggccuggaaacaugcucagaggguagaguccuggauacugcggaauccaggauucgcauugcucgccggcuuuauggcuuacaugauuggucaaacggggauccagcgaacuguuuucuuugugcugaugauguuagucgccccgucuuauggaaugcgcugugugggcgugggcaacagagauuucgucgaagggguuagcggaggugcguggguggaccugguacucgagcacggcgggugcgugacaaccauggcacagggaaagcccacucuugauuuugaacugacaaaaaccacggccaaggaggucgcuuugcuaaggaccuacuguauugaggccuccaucucaaauaucacaacugcaacccggugcccuacacagggcgaaccauaucugaaagaggaacaagaccagcaguacauuugucgcagagaugugguugacagggguugggggaacggcugcggacucuucggcaaagggggaguggucacuugcgcuaaguucaguuguagcgguaagauaaccggcaaucuggugcagaucgagaaccuugaauauacaguaguugugaccguccauaauggggauacucacgccgugggaaacgacacgucuaaccacggcgucacagcgaccauuacuccccguuccccuucaguggagguuaagcugccagauuacggugaguugacccucgacugcgaaccccggagcgggaucgacuuuaaugagaugauacugaugaaaaugaagaaaaagacaugguuagugcauaagcaaugguuccuggaucuaccgcucccuuggaccgccggcgcagacacaagugaaguacacuggaacuacaaagagcgaauggucacuuuuaaggugccccaugcuaaaagacaggauguuacggugcugggaucucaggaaggcgccaugcacuccgcucuugccggggcaaccgaggucgacagcggagaugguaaucacauguucgccggccauuugaaguguaaagugaggauggagaagcugcgcauuaaggggaugucguauacuaugugcucuggaaaauuuuccaucgacaaggaaauggcugagacacaacacggcaccacaguagugaaaguuaaguacgaaggugcgggggcaccauguaaagucccuaucgagauucgggaugugaacaaggagaagguggucggcagaguuaucucaaguacuccccucgccgaaaauaccaacagcgugacgaauauugagcuggaaccacccuucggagacuccuauauagugaucggcguagggaacucugcucuuacccugcauugguuuaggaaaggaagcucaauuggcaagauguucgagaguacauaccgcggugccaaacgaauggcaaucuugggggaaacugccugggauuuuggauccgucggcggucucuucaccagccugggcaaggcugugcaccagguuuuugggucuguguauacaacuauguucggaggcgucucauggaugauccggauuuuaauaggguuucuggugcuauggaucggaaccaauagucguaacacgagcauggccaugacaugcauugcaguuggcgguaucacccucuuccugggguucacugugcaggcg

SEQ ID NO: 1792 - RNA, 45 nt, Artificial Sequence
  derived and/or modified CDS sequence (opt3) from DENV-4 Consensus__SSc
augagcaccaucacacugcucugccuuauucccacugugauggcc

SEQ ID NO: 1793 - RNA, 57 nt, Artificial Sequence
  derived and/or modified CDS sequence (opt3) from DENV-4 Consensus__SSopt
augaagagaaagaaaagcaccaucacacugcucugccuuauucccacugugauggcc

SEQ ID NO: 1794 - RNA, 57 nt, Artificial Sequence
  derived and/or modified CDS sequence (opt3) from DENV-4 Consensus__SSm
augauccagagaaccguguucuuuguccugaugaugcucguugcccccagcuacggc

SEQ ID NO: 1795 - RNA, 1488 nt, Artificial Sequence
  derived and/or modified CDS sequence (opt3) from DENV-4 Consensus__E
augagaugcgugggcgucgggaacagggacuucguugagggagugagcgguggcgccuggguagaucuggugcucgaacacgggggaugugucaccacaauggcucagggcaagcccacucuugacuuugagcugacgaaaaccacagcaaaggaaguggccuuguuacggacuuacugcaucgaggcguccauuucuaauauaaccacagcuacccgcuguccuacucaaggugaaccauaucugaaagaggagcaggaucagcaguacaucugccgacgugacguuguggauagaggguggggaaacggcuguggccuauucgggaagggaggugucgugacaugcgccaaauuuucauguaguggcaagauuaccgggaaucucguacaaaucgaaaaccuggaguauacgguuguggucacugugcauaauggagacacccacgcagugggcaacgauacaagcaaucauggugucacugccaccauuacaccgaggucccccucuguugaagugaaacuuccugacuacggggagcugaccuuggauugcgagccacggucgggaaucgacuucaacgaaaugauacucaugaagaugaagaaaaagacguggcugguacacaaacagugguuucuggaucuccccuuaccuuggacugcuggcgcagacacaucagaggugcauuggaauuauaaggaacgcauggucaccuucaaggugccacacgccaaaagacaggauguuacugugcugggcagccaggagggggcuaugcacagugcccuugcgggagcaacagaagucgacuccggugacggcaaccauauguuugccgggcacuugaaguguaaagugaggauggagaagcugcggaucaaaggaaugucuuacaccaugugcagcggcaaguucuccauugauaaagagauggcugaaacgcaacaugguaccacaguaguuaaggugaaguaugagggggccggcgcacccuguaaagucccuaucgaaauucgcgacgugaauaaggagaaagucgugggacgaguuaucucaaguacuccacuagcugaaaacaccaauagcgugacaaacauagagcucgagccgcccuuuggcgauucuuacauuguaaucggggucggaaauuccgcccugacucuucacugguucagaaaggguucaagcauuggcaaaauguuugaaaguaccuacaggggagcgaagcggauggccauccugggggagacagcaugggacuucggcucuguggguggguuguuuaccucccucggcaaggcuguucaccagguguucggaagcgucuauacuacgauguucggcggggugucguggaugauccguauucugauaggauuuuuaguacuguggaucgguacaaacucucgcaacaccuccauggccaugacuugcauugcugugggcgggaucacccucuuccuuggauuuacaguucaggccuga

SEQ ID NO: 1796 - RNA, 1182 nt, Artificial Sequence
  derived and/or modified CDS sequence (opt3) from DENV-4 Consensus__EdelTM-variant (aa1-394)
augagaugcgugggcgucgggaacagggacuucguugagggagugagcgguggcgccuggguagaucuggugcucgaacacgggggaugugucaccacaauggcucagggcaagcccacucuugacuuugagcugacgaaaaccacagcaaaggaaguggccuuguuacggacuuacugcaucgaggcguccauuucuaauauaaccacagcuacccgcuguccuacucaaggugaaccauaucugaaagaggagcaggaucagcaguacaucugccgacgugacguuguggauagaggguggggaaacggcuguggccuauucgggaagggaggugucgugacaugcgccaaauuuucauguaguggcaagauuaccgggaaucucguacaaaucgaaaaccuggaguauacgguuguggucacugugcauaauggagacacccacgcagugggcaacgauacaagcaaucauggugucacugccaccauuacaccgaggucccccucuguugaagugaaacuuccugacuacggggagcugaccuuggauugcgagccacggucgggaaucgacuucaacgaaaugauacucaugaagaugaagaaaaagacguggcugguacacaaacagugguuucuggaucuccccuuaccuuggacugcuggcgcagacacaucagaggugcauuggaauuauaaggaacgcauggucaccuucaaggugccacacgccaaaagacaggauguuacugugcugggcagccaggagggggcuaugcacagugcccuugcgggagcaacagaagucgacuccggugacggcaaccauauguuugccgggcacuugaaguguaaagugaggauggagaagcugcggaucaaaggaaugucuuacaccaugugcagcggcaaguucuccauugauaaagagauggcugaaacgcaacaugguaccacaguaguuaaggugaaguaugagggggccggcgcacccuguaaagucccuaucgaaauucgcgacgugaauaaggagaaagucgugggacgaguuaucucaaguacuccacuagcugaaaacaccaauagcgugacaaacauagagcucgagccgcccuuuggcgauucuuacauuguaaucggggucggaaauuccgcccugacucuucacugguucagaaag

SEQ ID NO: 1797 - RNA, 1272 nt, Artificial Sequence
  derived and/or modified CDS sequence (opt3) from DENV-4 Consensus__EdelTM-variant (aa1-424)
augagaugcgugggcgucgggaacagggacuucguugagggagugagcgguggcgccuggguagaucuggugcucgaacacgggggaugugucaccacaauggcucagggcaagcccacucuugacuuugagcugacgaaaaccacagcaaaggaaguggccuuguuacggacuuacugcaucgaggcguccauuucuaauauaaccacagcuacccgcuguccuacucaaggugaaccauaucugaaagaggagcaggaucagcaguacaucugccgacgugacguuguggauagaggguggggaaacggcuguggccuauucgggaagggaggugucgugacaugcgccaaauuuucauguaguggcaagauuaccgggaaucucguacaaaucgaaaaccuggaguauacgguuguggucacugugcauaauggagacacccacgcagugggcaacgauacaagcaaucauggugucacugccaccauuacaccgaggucccccucuguugaagugaaacuuccugacuacggggagcugaccuuggauugcgagccacggucgggaaucgacuucaacgaaaugauacucaugaagaugaagaaaaagacguggcugguacacaaacagugguuucuggaucuccccuuaccuuggacugcuggcgcagacacaucagaggugcauuggaauuauaaggaacgcauggucaccuucaaggugccacacgccaaaagacaggauguuacugugcugggcagccaggagggggcuaugcacagugcccuugcgggagcaacagaagucgacuccggugacggcaaccauauguuugccgggcacuugaaguguaaagugaggauggagaagcugcggaucaaaggaaugucuuacaccaugugcagcggcaaguucuccauugauaaagagauggcugaaacgcaacaugguaccacaguaguuaaggugaaguaugagggggccggcgcacccuguaaagucccuaucgaaauucgcgacgugaauaaggagaaagucgugggacgaguuaucucaaguacuccacuagcugaaaacaccaauagcgugacaaacauagagcucgagccgcccuuuggcgauucuuacauuguaaucggggucggaaauuccgcccugacucuucacugguucagaaaggguucaagcauuggcaaaauguuugaaaguaccuacaggggagcgaagcggauggccauccugggggagacagcaugggacuucggcucu

SEQ ID NO: 1798 - RNA, 1266 nt, Artificial Sequence
  derived and/or modified CDS sequence (opt3) from DENV-4 Consensus__EdelTM-variant (aa1-421)
augagaugcgugggcgucgggaacagggacuucguugagggagugagcgguggcgccuggguagaucuggugcucgaacacgggggaugugucaccacaauggcucagggcaagcccacucuugacuuugagcugacgaaaaccacagcaaaggaaguggccuuguuacggacuuacugcaucgaggcguccauuucuaauauaaccacagcuacccgcuguccuacucaaggugaaccauaucugaaagaggagcaggaucagcaguacaucugccgacgugacguuguggauagaggguggggaaacggcuguggccuauucgggaagggaggugucgugacaugcgccaaauuuucauguaguggcaagauuaccgggaaucucguacaaaucgaaaaccuggaguauacgguuguggucacugugcauaauggagacacccacgcagugggcaacgauacaagcaaucauggugucacugccaccauuacaccgaggucccccucuguugaagugaaacuuccugacuacggggagcugaccuuggauugcgagccacggucgggaaucgacuucaacgaaaugauacucaugaagaugaagaaaaagacguggcugguacacaaacagugguuucuggaucuccccuuaccuuggacugcuggcgcagacacaucagaggugcauuggaauuauaaggaacgcauggucaccuucaaggugccacacgccaaaagacaggauguuacugugcugggcagccaggagggggcuaugcacagugcccuugcgggagcaacagaagucgacuccggugacggcaaccauauguuugccgggcacuugaaguguaaagugaggauggagaagcugcggaucaaaggaaugucuuacaccaugugcagcggcaaguucuccauugauaaagagauggcugaaacgcaacaugguaccacaguaguuaaggugaaguaugagggggccggcgcacccuguaaagucccuaucgaaauucgcgacgugaauaaggagaaagucgugggacgaguuaucucaaguacuccacuagcugaaaacaccaauagcgugacaaacauagagcucgagccgcccuuuggcgauucuuacauuguaaucggggucggaaauuccgcccugacucuucacugguucagaaaggguucaagcauuggcaaaauguuugaaaguaccuacaggggagcgaagcggauggccauccugggggagacagcaugggacuga

SEQ ID NO: 1799 - RNA, 2031 nt, Artificial Sequence
  derived and/or modified CDS sequence (opt3) from DENV-4 Consensus__SSc-prME
augagcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguaugggaccugcacgcagucaggcgagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguagcauuggaaagauguucgaguccacuuaccggggcgcaaaacgcauggccaucuuaggugaaaccgcuugggauuuugggucugugggcggacuguucacgagccuaggcaaggccguccaccagguuuuugggucaguguauaccacaauguucggaggcgugaguuggaugaucaggauucucaucgguuuucugguacuuuggauugggacuaauuccagaaacaccagcauggcaaugacaugcauagccgucggaggcaucacuuuguuccuggguuuuaccgugcaggcuuga

SEQ ID NO: 1800 - RNA, 2031 nt, Artificial Sequence
  derived and/or modified CDS sequence (opt3) from DENV-4 Consensus__SSc-prME(F108S)
augagcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguaugggaccugcacgcagucaggcgagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacugucugguaaaggcggggugguaacaugcgcuaaguucagcuguuccggaaaaaucacuggcaauuuggugcaaauagagaaccucgaauauaccgucgugguuacagugcauaauggugauacucacgccgucgggaacgacaccucaaaucacggcgugacagcaaccauuacuccucguaguccaagcguagagguuaagcugccggauuacggagaauuaacgcuggacugcgagccccgcucuggcaucgacuuuaacgagaugauucucaugaagaugaaaaagaaaacauggcuugugcauaagcagugguuccuggauuugccucuaccauggaccgcuggggccgacacuuccgaaguccacuggaauuacaaagagagaauggugaccuuuaaggucccccaugcgaaaaggcaggaugugacaguucugggaucacaggaaggugccaugcacagcgcacucgcuggcgccaccgagguggacaguggggauggaaaccacauguucgcuggccaucugaaguguaagguacggauggaaaaacuucgaaucaaggguaugucuuauacuaugugcuccgggaaauuuagcaucgacaaggagauggccgagacacaacacggcacgaccgucgugaaaguuaaguacgaaggagcaggcgccccuuguaaggugccaauugagauacgcgaugucaauaaagaaaaggugguagggagagugaucucgucuacuccccuggcugagaacacaaacuccguuaccaauauugaguuggaaccgccuuucggagacucauauaucgucauaggugugggcaacagugcgcucacacugcauugguucaggaaagggagcuccauuggaaagauguuugagucuacuuaccggggcgcaaaacgcauggccaucuuaggugaaaccgcuugggauuucgggagcgugggcggacuguuuacgucacuaggcaaggccguccaccagguuuucgggaguguguauaccacaauguuuggaggcguguccuggaugaucaggauucucaucgguuuccugguacuuuggauugggacuaauagcagaaacaccucuauggcaaugacaugcauagccgucggaggcaucacuuuguuucuggguuucaccgugcaggcuuga

SEQ ID NO: 1801 - RNA, 2031 nt, Artificial Sequence
  derived and/or modified CDS sequence (opt3) from DENV-4 Consensus__SSc-prMEdelstem_TM-JEV
augagcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguaugggaccugcacgcagucaggcgagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguacuuuaggaaaggcauucagcaccacgcugaaaggcgcccagcggcuagcugcccucggugauaccgcaugggacuuuggguccauuggcggaguguucaauucuaucggccgcgccguccaccagguuuuugggggagcuuucagaacacuguuuggcgguaugagcuggaucacucaagggcuuaugggagccuugcugcucuggaugggcgugaacgcaagggaucguucaauugcgcuggcuuuccuugccaccgguggcgugcugguauuuuuggcaacaaauguccaugccuga

SEQ ID NO: 1802 - RNA, 1332 nt, Artificial Sequence
  derived and/or modified CDS sequence (opt3) from DENV-4 Consensus__SSm-EdelTM
augauccagagaaccguguucuuuguccugaugaugcucguugcccccagcuacggcaugaggugcguggggguaggaaaccgggacuucguggagggugucuccggcggggcuuggguggaucuuguucuggaacacggaggcugugugacaacuauggcacaagguaagccuacguuggacuuugaguuaaccaaaacaacugccaaggaagucgcgcugcuacgcaccuauugcauugaggcuucuauaucaaauaucacaaccgccacucgauguccaacacagggggaaccguaccucaaagaggagcaggaucagcaauauauuugccguagagacgugguagauaggggauggggcaacggcugugggcuguucggaaaggguggcguugugaccugcgcaaaauuuaguuguagcgggaagaucacgggaaaucuuguccagauugaaaaccuggaguacacugugguggucaccguucauaauggcgacacacacgccguggguaacgauacuuccaaucaugggguaaccgcuacaaucacgccccggucuccuucgguggaagucaaguugccagacuauggagagcucacccuggauugcgagccccgcucaggcauagacuucaacgaaaugauccugaugaaaaugaagaaaaagacuuggcucgugcacaaacagugguuuuuagaucugccucuuccauggacagcaggcgccgacaccagcgagguucauuggaauuacaaggaaagaauggugacuuucaaggucccccacgcuaaaaggcaggaugugacaguauuggggagucaagagggagccaugcacuccgcgcuggccggugcaaccgaaguugacucuggcgacgggaaccauauguuugcuggacaccuaaaguguaaagugcggauggagaagcuccgcauuaaaggcaugagcuauacgaugugcuccgguaaguucucaaucgauaaagagauggccgaaacccagcaugggacaacugucgugaaggucaaguacgagggcgcaggagcuccuuguaaagugccaauugaaauccgagacguuaauaaggagaaagugguaggcagagucauaaguagcaccccgcuggccgaaaacacaaauucugugacuaacauugagcuugagcccccuuuuggggauuccuacaucguuauuggaguggguaauucagcgcugaccuugcacugguucaggaagggcagcaguaucgggaaaauguuugaaucuacauaucggggagccaagcguauggcaauccucggcgagaccgcuugggacuucgguuccuga

SEQ ID NO: 1803 - RNA, 2376 nt, Artificial Sequence
  derived and/or modified CDS sequence (opt3) from DENV-4 Consensus__C-P2A-SSc-prME
augaaccagagaaagaaaguggucaggcccccuuucaauaugcugaagcgggagcgcaaccgaguuagcaccccacaaggccucgugaaacguuuuuccacagggcuuuucucuggaaaggguccgcugagaaugguauuggccuuuaucacuuucuuaagggugcugucaauucccccuacggcuggcauacuaaaacggugggggcagcucaagaagaauaaagcaaucaagauucugaucggauuucgcaaagaaauuggcagaaugcuuaacauccugaaugguaggaagcggaacuucgacuugcucaaacuggccggggaugucgagaguaauccaggacccagcaccauaacacugcucugcuuaaucccuacugugauggcguuucaccuguccacccgcgacggcgaaccacuuaugauuguugcuaagcaugagcgaggcagacccuugcuguucaagacaaccgaagggaucaacaaauguacucuaauugccauggaucucggagagaugugcgaggacacagugaccuacaaguguccucugcuugucaauacggaaccagaggauaucgacugcugguguaaccugacuucuaccugggugauguaugguacaugcacucagucgggcgaaaggcggcgugagaaacgcucaguagcauugaccccgcacagcgggaugggacucgagacaagagccgaaaccuggaugaguuccgagggcgcuuggaagcaugcacagaggguugaaucuuggauacugcggaaucccgguuuugccuuacuggcuggguucauggccuacaugauuggacaaacgggcauccagcgaacuguguuuuucguccucaugaugcuuguggcgccuagcuauggcaugcgcugugugggggucggaaacagagauuuuguugaggguguguccggcggggcauggguagaccugguguuggaacacggaggcugcgucacaaccauggcccaggguaaaccaacucuagauuucgagcugacaaagaccacggcuaaagagguggcccuccugaggaccuacuguauugaagcaucaaucaguaauaucacaacugcuacccggugccccacacagggggagccuuaucuuaaggaggaacaagaccagcaguacauuugucgcagagauguuguggacaggggcuggggaaacggcugcgggcuguucggaaaggguggcgucgugacuugcgccaaauuuagcuguucugggaagauaaccggaaauuugguacagaucgaaaaccucgaguauacaguuguggucaccgugcauaacggcgauacucacgcggucgguaaugacacguccaaccacggggugacagccaccauuacuccacguucacccagcguugaggugaaacugccggacuacggcgaauuaacccuggauugcgagccucggaguggaaucgacuucaaugaaaugauacuaaugaagaugaaaaagaagacauggcucguacauaaacaaugguuucuggaucuucccuugccauggaccgcaggcgcugacacuucugagguccacuggaacuacaaggaacgaauggugacauucaaaguuccucaugccaagagacaggaugugacgguccuggggucccaggagggagcuaugcacagcgcccucgcaggggccaccgagguggacucgggcgaugggaaucacauguuugcuggacaucugaaauguaagguaaggauggaaaaacuucgcauuaagggcaugucuuauacuaugugcuccgguaaguucucaaucgacaaagagauggcggaaacacaacacgggaccacagugguuaaggucaaauacgagggcgcaggagcccccuguaaggugccaaucgagauucgggaugugaacaaggaaaaagucguuggcagagugaucaguagcacuccccuggcugagaauaccaacuccgugacgaauauugaauuggagccuccauuuggggacucuuauauaguaaucggagucggcaacagcgcccucacccugcauugguucaggaaggguucaaguauugggaaaauguuugaauccacauaccgcggagcaaagcgaauggccaucuuaggcgagacugcuugggauuucgguagcgugggcgggcuguuuaccucucuaggaaaagccguucaccagguguucggcucagucuauacaacuauguuugggggagugaguuggaugauccggauucucauaggcuuccugguucuuuggaucgguaccaauagccguaacacguccauggcaaugacaugcauugcgguggguggaaucaccuuguuccugggcuuuacuguacaggcuuga

SEQ ID NO: 1804 - RNA, 2043 nt, Artificial Sequence
  derived and/or modified CDS sequence (opt3) from DENV-4 Consensus__SSopt-prME(F108S)
augaagaggaaaaagagcaccaucacacugcucugccuuauucccacugugauggccuuccaccuguccacgagagacggcgagccuuugaugauagucgcuaaacaugaacgggggcgcccauuacuguuuaagaccacagagggaaucaacaaauguacucuaauugcaauggaucucggugaaaugugcgaggacaccguuacauacaaguguccgcugcuugugaauaccgaacccgaggauaucgacugcugguguaaccugacuucuacauggguaauguaugggaccugcacgcagucaggcgagcgacguagagaaaagaggaguguggccuugacuccucacagcggaaugggccucgagacccgggcggaaacauggauguccucugagggugcuuggaaacaugcccaacgcgucgagucguggauucugagaaauccaggguucgcacugcucgccggauuuauggcuuacaugaucggccagacuggcauacagaggaccguguucuuuguuuuaaugaugcugguggcacccucauaugggaugcggugugucggaguggguaaccgcgauuucguagaaggcguuagcgggggagccuggguggaccuugucuuggagcacggcgguugcgugacaaccauggcucaggggaagccuacgcuggauuuugaacuaacuaaaacaaccgccaaggagguggcgcuccugcgaacuuacuguaucgaagcaaguauuuccaauaucacaaccgccacgagaugcccaacccaaggagagcccuaucuuaaagaggaacaggaccagcaguacauuuguaggcgggaugucguugaccguggcuggggcaacgggugcggacugucugguaagggcggggugguaacaugcgcuaaguucagcuguuccggaaaaaucacuggcaauuuggugcaaauagagaaccucgaauauaccgucgugguuacagugcauaauggugauacucacgccgucgggaacgacaccucaaaucacggcgugacagcaaccauuacuccucgcaguccaagcguagagguuaagcugccggauuacggagaauuaacgcuggacugcgagcccagaucuggcaucgacuuuaacgagaugauucucaugaaaaugaagaaaaagacauggcuugugcauaaacagugguuccuggauuugccucuaccauggaccgcuggggccgacacuuccgaaguccacuggaauuacaaggagaggauggugaccuuuaaggucccccaugcgaaacggcaggaugugacaguucugggaucacaggaaggugccaugcacagcgcacucgcuggcgccaccgagguggacaguggggauggaaaccacauguucgcuggccaucugaaguguaaaguacgaauggaaaaacuucgcaucaaggguaugucuuauacuaugugcuccgggaaguuuagcaucgacaaggagauggccgagacacaacacggcacgaccgucgugaaaguuaaguacgaaggagcaggcgccccuuguaaagugccaauugagauaagagaugucaauaaggaaaaagugguagggagggugaucucgucuacuccccuggcugagaacacaaacuccguuaccaauauugaguuggaaccgccuuucggagacucauauaucgucauaggugugggcaacagugcgcucacacugcauugguuccggaaggggagcuccauuggaaagauguuugagucuacuuaccgcggcgcaaaaagaauggccaucuuaggugaaaccgcuugggauuucgggagcgugggcggacuguuuacgucacuaggcaaggccguccaccagguuuucgggaguguguauaccacaauguuuggaggcguguccuggaugaucaggauucucaucgguuuccugguacuuuggauugggacuaauagccguaacaccucuauggcaaugacaugcauagccgucggaggcaucacuuuguuucuggguuucaccgugcaggcuuga

SEQ ID NO: 1805 - RNA, 2043 nt, Artificial Sequence
  derived and/or modified CDS sequence (opt3) from DENV-4 Consensus__SSopt-prME(V96H)
augaagaggaaaaagagcaccaucacacugcucugccuuauucccacugugauggccuuccaccuguccacgagagacggcgagccuuugaugauagucgcuaaacaugaacgggggcgcccauuacuguuuaagaccacagagggaaucaacaaauguacucuaauugcaauggaucucggugaaaugugcgaggacaccguuacauacaaguguccgcugcuugugaauaccgaacccgaggauaucgacugcugguguaaccugacuucuacauggguaauguaugggaccugcacgcagucaggcgagcgacguagagaaaagaggaguguggccuugacuccucacagcggaaugggccucgagacccgggcggaaacauggauguccucugagggugcuuggaaacaugcccaacgcgucgagucguggauucugagaaauccaggguucgcacugcucgccggauuuauggcuuacaugaucggccagacuggcauacagaggaccguguucuuuguuuuaaugaugcugguggcacccucauaugggaugcggugugucggaguggguaaccgcgauuucguagaaggcguuagcgggggagccuggguggaccuugucuuggagcacggcgguugcgugacaaccauggcucaggggaagccuacgcuggauuuugaacuaacuaaaacaaccgccaaggagguggcgcuccugcgaacuuacuguaucgaagcaaguauuuccaauaucacaaccgccacgagaugcccaacccaaggagagcccuaucuuaaagaggaacaggaccagcaguacauuuguaggcgggaucaugucgaccguggcuggggcaacgggugcggacuguucgguaagggcgggguugugacaugcgcuaaguuuucuuguagcggaaaaaucacuggcaauuugguacaaauagagaaccucgaauauaccguggucgugacaguucacaauggugauacucacgccguggggaacgacaccuccaaucauggcgucacagcaaccauuacuccucgcucaccaaguguggagguaaagcugccggauuacggagaauuaacgcuggacugcgagcccagaagcggcaucgacuucaacgagaugauucucaugaaaaugaagaaaaagacauggcuuguucacaaacagugguuucuggauuugccucuaccauggaccgcuggggccgacacuucugaagugcauuggaauuacaaggagaggauggucaccuucaaggugccccacgcgaaacggcaggaugucacagugcugggaucccaggaaggugccaugcacucagcacucgcuggcgccaccgagguugacagcggggauggaaaccauauguuugcuggccaccugaaguguaaagugcgaauggaaaaacuucgcaucaaggguaugaguuauacuaugugcucugggaaguucuccaucgacaaggagauggccgagacacaacauggcacgaccguagucaaagugaaguacgaaggagcaggcgccccuuguaaaguuccaauugagauaagagaugugaauaaggaaaaagucguggggaggguaaucagcucgacuccccuggcugagaacacaaacucugugaccaauauugaguuggaaccgccuuucggagacuccuauaucguuauaggugucggcaacucagcgcucacacugcacugguuucggaaggggaguagcauuggaaagauguucgaguccacuuaccgcggcgcaaaaagaauggccaucuuaggugaaaccgcuugggauuuugggucugugggcggacuguucacgagccuaggcaaggccgugcaucaggucuuugggucaguuuauaccacaauguucggaggcgugaguuggaugaucaggauucucaucgguuuucuggugcuuuggauugggacuaauucccguaacaccagcauggcaaugacaugcauagccguaggaggcaucacuuuguuccuggguuuuaccguccaggcuuga

SEQ ID NO: 1806 - RNA, 2043 nt, Artificial Sequence
  derived and/or modified CDS sequence (opt3) from DENV-4 Consensus__SSopt-prME(E186F)
augaagaggaaaaagagcaccaucacacugcucugccuuauucccacugugauggccuuccaccuguccacgagagacggcgagccuuugaugauagucgcuaaacaugaacgggggcgcccauuacuguuuaagaccacagagggaaucaacaaauguacucuaauugcaauggaucucggugaaaugugcgaggacaccguuacauacaaguguccgcugcuugugaauaccgaacccgaggauaucgacugcugguguaaccugacuucuacauggguaauguaugggaccugcacgcagucaggcgagcgacguagagaaaagaggaguguggccuugacuccucacagcggaaugggccucgagacccgggcggaaacauggauguccucugagggugcuuggaaacaugcccaacgcgucgagucguggauucugagaaauccaggguucgcacugcucgccggauuuauggcuuacaugaucggccagacuggcauacagaggaccguguucuuuguuuuaaugaugcugguggcacccucauaugggaugcggugugucggaguggguaaccgcgauuucguagaaggcguuagcgggggagccuggguggaccuugucuuggagcacggcgguugcgugacaaccauggcucaggggaagccuacgcuggauuuugaacuaacuaaaacaaccgccaaggagguggcgcuccugcgaacuuacuguaucgaagcaaguauuuccaauaucacaaccgccacgagaugcccaacccaaggagagcccuaucuuaaagaggaacaggaccagcaguacauuuguaggcgggaugucguugaccguggcuggggcaacgggugcggacuguucgguaagggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucgcucaccaaguguagagguuaagcugccggauuacggagaauuaacgcuggacugcuuccccagaagcggcaucgacuuuaacgagaugauucucaugaaaaugaagaaaaagacauggcuugugcauaaacagugguuccuggauuugccucuaccauggaccgcuggggccgacacuucugagguccacuggaauuacaaggaaaggauggugaccuuuaaggucccccaugcgaaacggcaggaugugacaguucugggaucccaggagggugccaugcacucagcacucgcuggcgccaccgaaguggacagcggggauggaaaccacauguucgcuggccaucugaaguguaaaguacgaauggagaaacuucgcaucaaggguaugaguuauacuaugugcucugggaaguucuccaucgacaaggaaauggccgagacacaacacggcacgaccgucgugaaaguuaaguacgagggagcaggcgccccuuguaaagugccaauugaaauaagagaugucaauaaggagaaagugguagggagggugaucagcucgacuccccuggcugaaaacacaaacucuguuaccaauauugaguuggagccgccuuuuggagacuccuauaucgucauaggugugggcaacucagcgcucacacugcauugguuccggaaggggaguagcauuggaaagauguuugaauccacuuaccgcggcgcaaaaagaauggccaucuuaggugagaccgcuugggauuucgggucugugggcggacuguuuacgagccuaggcaaggccguccaccagguuuucgggucaguguauaccacaauguuuggaggcgugaguuggaugaucaggauucucaucgguuuccugguacuuuggauugggacuaauucccguaacaccagcauggcaaugacaugcauagccgucggaggcaucacuuuguuucuggguuucaccgugcaggcuuga

SEQ ID NO: 1807 - RNA, 2043 nt, Artificial Sequence
  derived and/or modified CDS sequence (opt3) from DENV-4 Consensus__SSopt-prME(R188L)
augaagaggaaaaagagcaccaucacacugcucugccuuauucccacugugauggccuuccaccuguccacgagagacggcgagccuuugaugauagucgcuaaacaugaacgggggcgcccauuacuguuuaagaccacagagggaaucaacaaauguacucuaauugcaauggaucucggugaaaugugcgaggacaccguuacauacaaguguccgcugcuugugaauaccgaacccgaggauaucgacugcugguguaaccugacuucuacauggguaauguaugggaccugcacgcagucaggcgagcgacguagagaaaagaggaguguggccuugacuccucacagcggaaugggccucgagacccgggcggaaacauggauguccucugagggugcuuggaaacaugcccaacgcgucgagucguggauucugagaaauccaggguucgcacugcucgccggauuuauggcuuacaugaucggccagacuggcauacagaggaccguguucuuuguuuuaaugaugcugguggcacccucauaugggaugcggugugucggaguggguaaccgcgauuucguagaaggcguuagcgggggagccuggguggaccuugucuuggagcacggcgguugcgugacaaccauggcucaggggaagccuacgcuggauuuugaacuaacuaaaacaaccgccaaggagguggcgcuccugcgaacuuacuguaucgaagcaaguauuuccaauaucacaaccgccacgagaugcccaacccaaggagagcccuaucuuaaagaggaacaggaccagcaguacauuuguaggcgggaugucguugaccguggcuggggcaacgggugcggacuguucgguaagggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucgcucaccaaguguagagguuaagcugccggauuacggagaauuaacgcuggacugcgagccccucagcggcaucgacuucaacgagaugauucuuaugaaaaugaagaaaaagacauggcuggugcauaaacagugguuuuuggaucuaccucugccauggaccgcuggggccgacacuucugaaguccacuggaauuacaaggagagaauggugaccuucaaggucccccaugcgaaaaggcaggaugugacaguucucggaucccaggaaggugccaugcacucagcacuggcuggcgccaccgagguggacagcggggauggaaaccacauguuugcuggccaucuuaaguguaaaguacggauggaaaagcugcgaaucaaagguaugaguuauacuaugugcucugggaaguucuccaucgacaaggagauggccgagacacaacacggcacgaccgucgugaaaguuaaguacgaaggagcaggcgccccuuguaaagugccaauugagauacgcgaugucaauaaggaaaaagugguagggagagugaucagcucgacucccuuggcugagaacacaaacucuguuaccaauauugagcucgaaccgccuuucggagacuccuauaucgucauaggugugggcaacucagcgcugacauuacauugguuuaggaaggggaguagcauuggaaagauguucgaguccacuuaccggggcgcaaaacgcauggccauccugggugaaaccgcuugggauuuugggucugugggcggacuauucacgagccucggcaaggccguccaccagguuuuugggucaguguauaccacaauguucggaggcgugaguuggaugaucaggauucugaucgguuuucuuguauuguggauugggacuaauuccagaaacaccagcauggcaaugacaugcauagccgucggaggcaucacucuguuccucgguuuuaccgugcaggcuuga

SEQ ID NO: 1808 - RNA, 2043 nt, Artificial Sequence
  derived and/or modified CDS sequence (opt3) from DENV-4 Consensus__SSopt-pr(D104A)MEdelstem_TM,(F108S)-JEV
augaagaggaaaaagagcaccaucacacugcucugccuuauucccacugugauggccuuccaccuguccacgagagacggcgagccuuugaugauagucgcuaaacaugaacgggggcgcccauuacuguuuaagaccacagagggaaucaacaaauguacucuaauugcaauggaucucggugaaaugugcgaggacaccguuacauacaaguguccgcugcuugugaauaccgaacccgaggauaucgacugcugguguaaccugacuucuacauggguaauguaugggaccugcacgcagucaggcgagcgacguagagccaagaggaguguggcguugacuccucacagcggaaugggccucgaaacccgggcugagacauggauguccucugaaggugccuggaaacaugcacaacgcgucgagucguggauucugagaaauccaggguucgcccugcucgcuggauuuauggcauacaugaucggccagacuggcauacagaggaccguguucuuuguuuuaaugaugcugguggcccccucauaugggaugcggugugucggaguggguaaccgcgauuucguagagggcguuagcgggggagcuuggguggaccuugucuuggaacacggcgguugcgugacaaccauggcccaggggaagccuacgcuggauuuugagcuaacuaaaacaaccgcgaaggaaguggcacuccugcgaacuuacuguaucgaggccaguauuuccaauaucacaaccgcuacgagaugcccaacccaaggagaacccuaucuuaaagaggagcaggaccagcaguacauuuguaggcgggaugucguugaccguggcuggggcaacgggugcggacugucugguaagggcggggugguaacaugcgccaaguucagcuguuccggaaaaaucacuggcaauuuggugcaaauagaaaaccucgaguauaccgucgugguuacagugcauaauggugauacucacgcagucgggaacgacaccucaaaucacggcgugacagcuaccauuacuccucgcaguccaagcguagaaguuaagcugccggauuacggagaguuaacgcuggacugcgaacccagaucuggcaucgacuuuaacgagaugauucucaugaaaaugaagaaaaagacauggcuugugcauaaacagugguuccuggauuugccucuaccauggaccgccggggcggacacuuccgagguccacuggaauuacaaggaaaggauggugaccuuuaaggucccccaugccaaacggcaggaugugacaguucugggaucacaggagggugcaaugcacagcgcucucgccggcgcuaccgaaguggacaguggggauggaaaccacauguucgccggccaucugaaguguaaaguacgaauggagaaacuucgcaucaaggguaugucuuauacuaugugcuccgggaaguuuagcaucgacaaggaaauggcagagacacaacacggcacgaccgucgugaaaguuaaguacgagggagccggcgcuccuuguaaagugccaauugaaauaagagaugucaauaaggagaaagugguagggagggugaucucgucuacuccccuggcggaaaacacaaacuccguuaccaauauugaguuggagccgccuuucggagacucauauaucgucauaggugugggcaacagugcacucacacugcauugguuccggaaggggagcacuuuaggaaaggccuuuuccaccacgcugaaaggcgcucagcgccuagccgcacucggugauaccgccugggacuucgggucuauuggcggaguguuuaauagcaucggcagagcuguccaccagguuuucgggggagccuuuaggacacuguucggcgguaugucauggaucacucaagggcuuaugggagcauugcugcucuggaugggcgugaacgcgcgugaucggaguauugcucuggccuuucuugcaaccgguggcgugcugguauucuuggccacaaauguccaugcuuga

SEQ ID NO: 1809 - RNA, 2043 nt, Artificial Sequence
  derived and/or modified CDS sequence (opt3) from DENV-4 Consensus__SSopt-prMEdelstem_TM,(H261N)-JEV
augaagaggaaaaagagcaccaucacacugcucugccuuauucccacugugauggccuuccaccuguccacgagagacggcgagccuuugaugauagucgcuaaacaugaacgggggcgcccauuacuguuuaagaccacagagggaaucaacaaauguacucuaauugcaauggaucucggugaaaugugcgaggacaccguuacauacaaguguccgcugcuugugaauaccgaacccgaggauaucgacugcugguguaaccugacuucuacauggguaauguaugggaccugcacgcagucaggcgagcgacguagagaaaagaggaguguggccuugacuccucacagcggaaugggccucgagacccgggcggaaacauggauguccucugagggugcuuggaaacaugcccaacgcgucgagucguggauucugagaaauccaggguucgcacugcucgccggauuuauggcuuacaugaucggccagacuggcauacagaggaccguguucuuuguuuuaaugaugcugguggcacccucauaugggaugcggugugucggaguggguaaccgcgauuucguagaaggcguuagcgggggagccuggguggaccuugucuuggagcacggcgguugcgugacaaccauggcucaggggaagccuacgcuggauuuugaacuaacuaaaacaaccgccaaggagguggcgcuccugcgaacuuacuguaucgaagcaaguauuuccaauaucacaaccgccacgagaugcccaacccaaggagagcccuaucuuaaagaggaacaggaccagcaguacauuuguaggcgggaugucguugaccguggcuggggcaacgggugcggacuguucgguaagggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucgcucaccaaguguagagguuaagcugccggauuacggagaauuaacgcuggacugcgagcccagaagcggcaucgacuucaacgagaugauucucaugaaaaugaagaaaaagacauggcuugugcauaaacagugguuucuggauuugccucuaccauggaccgcuggggccgacacuucugaaguccacuggaauuacaaggagaggauggugaccuucaaggucccccaugcgaaacggcaggaugugacaguucugggaucccaggaaggugccaugaacucagcacucgcuggcgccaccgagguggacagcggggauggaaaucacauguuugcuggccaccugaaguguaaaguacgaauggaaaaacuucgcaucaaggguaugaguuauacuaugugcucugggaaguucuccaucgacaaggagauggccgagacacaacauggcacgaccgucgugaaaguuaaguacgaaggagcaggcgccccuuguaaagugccaauugagauaagagaugucaacaaggaaaaagugguagggagggugaucagcucgacuccccuggcugagaacacaaauucuguuaccaacauugaguuggaaccgccuuucggagacuccuauaucgucauaggugugggcaauucagcgcucacacugcacugguuucggaaggggaguacuuuaggaaaggcauucagcaccacgcugaaaggcgcccagcgccuagcugcccucggugauaccgcaugggacuuuggguccauuggcggaguguucaacucuaucggcagagccguccaucagguuuuugggggagcuuucaggacacuguuuggcgguaugagcuggaucacucaagggcuuaugggagccuugcugcucuggaugggcgugaaugcacgugaucggucaauugcgcuggcuuuccuugccaccgguggcgugcugguauuuuuggcaacaaacguccacgccuga

SEQ ID NO: 1810 - RNA, 2043 nt, Artificial Sequence
  derived and/or modified CDS sequence (opt3) from DENV-4 Consensus__SSopt-prMEdelstem_TM,(R188L,A267T)-JEV
augaagaggaaaaagagcaccaucacacugcucugccuuauucccacugugauggccuuccaccuguccacgagagacggcgagccuuugaugauagucgcuaaacaugaacgggggcgcccauuacuguuuaagaccacagagggaaucaacaaauguacucuaauugcaauggaucucggugaaaugugcgaggacaccguuacauacaaguguccgcugcuugugaauaccgaacccgaggauaucgacugcugguguaaccugacuucuacauggguaauguaugggaccugcacgcagucaggcgagcgacguagagaaaagaggaguguggccuugacuccucacagcggaaugggccucgagacccgggcggaaacauggauguccucugagggugcuuggaaacaugcccaacgcgucgagucguggauucugagaaauccaggguucgcacugcucgccggauuuauggcuuacaugaucggccagacuggcauacagaggaccguguucuuuguuuuaaugaugcugguggcacccucauaugggaugcggugugucggaguggguaaccgcgauuucguagaaggcguuagcgggggagccuggguggaccuugucuuggagcacggcgguugcgugacaaccauggcucaggggaagccuacgcuggauuuugaacuaacuaaaacaaccgccaaggagguggcgcuccugcgaacuuacuguaucgaagcaaguauuuccaauaucacaaccgccacgagaugcccaacccaaggagagcccuaucuuaaagaggaacaggaccagcaguacauuuguaggcgggaugucguugaccguggcuggggcaacgggugcggacuguucgguaagggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucgcucaccaaguguagagguuaagcugccggauuacggagaauuaacgcuggacugcgagccccucagcggcaucgacuucaacgagaugauucuuaugaaaaugaagaaaaagacauggcuggugcauaaacagugguuuuuggaucuaccucugccauggaccgcuggggccgacacuucugaaguccacuggaauuacaaggagagaauggugaccuucaaggucccccaugcgaaaaggcaggaugugacaguucucggaucccaggaaggugccaugcacucagcacuggcuggcaccacugagguggacagcggggauggaaaccacauguuugccggccaucuuaaguguaaaguacggauggaaaagcugcgaaucaaagguaugaguuauacaaugugcucugggaaguucuccaucgacaaggagauggcugagacgcaacacggcaccacugucgugaaaguuaaguacgaaggagccggcgcaccuuguaaagugccaauugagauacgcgaugucaauaaggaaaaagugguagggagagugaucagcucgacacccuuggccgagaacaccaacucuguuacaaauauugagcucgaaccgccuuucggagacuccuauaucgucauaggugugggcaacucagcucugacuuuacauugguuuaggaaggggaguacccugggaaaggcguucagcacgacccuaaaaggcgcacagcggcucgccgcucugggugauacagccugggacuuuggguccauuggcggaguguucaauucuaucggccgcgcaguccaccagguuuuugggggagccuucagaacucuuuuuggcgguaugagcuggaucacccaaggguugaugggagcucugcuccuguggaugggcgugaacgccagggaucguucaauugcacuugcguuccuggcuacagguggcguguugguauuucucgccacuaauguccaugcauga

SEQ ID NO: 1811 - RNA, 300 nt, Artificial Sequence
  derived and/or modified CDS sequence (opt3) from DENV-3 Consensus__C
augaacaaucagagaaagaaaaccggcaagcccagcaucaacaugcugaaaagggugcggaaucgcgucuccacagggucucaacucgccaagcgauucucaaaaggacuucugaacggucagggcccuaugaaguugguuauggcuuuuauugcauucuuacguuuucuggccauaccaccgacugcgggggugcuagcuagauggggaacguucaagaaaaguggcgccaucaagguacucaaagguuuuaagaaagagauuagcaauaugcuguccaucauuaacaagaggaagaaa

SEQ ID NO: 1812 - RNA, 342 nt, Artificial Sequence
  derived and/or modified CDS sequence (opt3) from DENV-3 Consensus__C-SSc
augaacaaucagagaaagaaaaccggcaagcccagcaucaacaugcugaaaagggugcggaaucgcgucuccacagggucucaacucgccaagcgauucucaaaaggacuucugaacggucagggcccuaugaaguugguuauggcuuuuauugcauucuuacguuuucuggccauaccaccgacugcgggggugcuagcuagauggggaacguucaagaaaaguggcgccaucaagguacucaaagguuuuaagaaagagauuagcaauaugcuguccaucauuaacaagaggaagaaaaccucucuuugccugaugaugaucuugcccgcagcccucgcu

SEQ ID NO: 1813 - RNA, 273 nt, Artificial Sequence
  derived and/or modified CDS sequence (opt3) from DENV-3 Consensus__pr
uuccaccugaccagcagagacggcgagcccaggaugaucguggggaagaacgaacggggaaaaucccuccuuuuuaagacagccucugguauuaauaugugcacucugauagcuauggauuugggcgagaugugugacgauacggucaccuacaaaugcccucauaucacagaaguugagccagaagacauugauuguuggugcaacuuaacuucaaccugggugacauaugggaccuguaaucaggcaggagagcaccgccgagacaagcgu

SEQ ID NO: 1814 - RNA, 225 nt, Artificial Sequence
  derived and/or modified CDS sequence (opt3) from DENV-3 Consensus__M
agcguggcccuggcuccccacgucggcauggggcucgacaccagaacacagacuuggauguccgcagagggagccuggaggcaaguugaaaagguggagacgugggcgcuucggcauccugguuucaccauccuggcuuuguuuuuagcccacuacauuggcacaucucugacucagaaaguagugauauucauccuacucaugcuggucaccccaucaaugaca

SEQ ID NO: 1815 - RNA, 498 nt, Artificial Sequence
  derived and/or modified CDS sequence (opt3) from DENV-3 Consensus__prM
uuccaccugaccagcagagacggcgagcccaggaugaucguggggaagaacgaacggggaaaaucccuccuuuuuaagacagccucugguauuaauaugugcacucugauagcuauggauuugggcgagaugugugacgauacggucaccuacaaaugcccucauaucacagaaguugagccagaagacauugauuguuggugcaacuuaacuucaaccugggugacauaugggaccuguaaucaggcaggagagcaccgccgagacaagcguaguguagcccuggcgccgcaugugggcaugggucuagauacuagaacacaaaccuggaugagcgcugagggggccuggaggcaggucgaaaaaguggagacgugggcacuccggcaccccggauucacuauccuggcccuuuuucuggcucauuacauuggcaccuccuugacacagaagguugugaucuucauacuccugaugcuggucacuccuucuaugacc

SEQ ID NO: 1816 - RNA, 1479 nt, Artificial Sequence
  derived and/or modified CDS sequence (opt3) from DENV-3 Consensus__E
augagaugcgugggcgucgggaacagggacuucguugagggacugagcggugccaccuggguggauguagugcucgaacacggcgggugugucacaacuauggcuaagaauaaacccacgcuugacaucgagcugcagaagaccgaagcaacacaauuggccacuuuacggaaacugugcauugagggaaagauaaccaacaucacaaccgauucccgcuguccuacucagggcgaagcgacacuaccagaggagcaggaccagaauuacgugugcaaacauaccuauguugaucgagguugggggaacggauguggccucuuuggcaaggggucucuggugacgugcgcuaaguuccaaugucuugaaccgauugagggaaaagucgugcaguacgaaaaucugaaguauacuguaaucauuaccguucacacaggugaccagcaucaggugggcaacgagacucaaggggucaccgccgagaucacaccccaggcaucaaccacggaagccauauugccugaguacggaacucucggccuggaaugcaguccacguacaggucuggauuuuaaugagaugauccucuuaaccaugaaaaacaaggcuuggauggugcacagacagugguucuuugaccugccccuuccuuggacuagcggggcaacaaccgaaacgccaaccuggaauaggaaagaguugcuggugacauucaagaacgcccaugcuaagaaacaggaggucguugugcuaggaucccaagaaggcgccaugcacacugcgcucaccggcgcaacagagauucaaaauucugggggaacuucgaucuuugccggucaccugaagugucggcuuaaaauggauaagcuggaauugaaaggcaugucauaugcuaugugcaccaacacauucguacucaagaaagaggugagcgaaacccagcaugggacuauucugaucaaggucgaguacaagggagaggacgugcccuguaaaauaccuuuuaguacggaagauggccaggguaaggcccacaaugggcgcuuaauuacagcaaacccaguugugaccaaaaaggaggaaccggucaauaucgaggcugaacccccuuucggcgaguccaacauugugaucggaaucggcgacaacgcccugaaaauuaauugguauaagaaggggucuagcauaggaaaaauguuugaggcgacugccagaggugcaaggcggauggcuauccucggcgauaccgccugggacuucggguccguaggaggcguucuuaacucacuggguaagauggugcaucagauuuuugggagugcuuacacagccuuguucagcggcgucucuugggugaugaaaaucggaauaggcguccuacugaccuggauugggcucaauuccaagaacacuucaaugagcuucaguugcaucgcaaucggaauuaucacacuguaccuuggugccgugguucaggcu

SEQ ID NO: 1817 - RNA, 1977 nt, Artificial Sequence
  derived and/or modified CDS sequence (opt3) from DENV-3 Consensus__prME
uuccaccugaccagcagagacggcgagcccaggaugaucguggggaagaacgaacggggaaaaucccuccuuuuuaagacagccucugguauuaauaugugcacucugauagcuauggauuugggcgagaugugugacgauacggucaccuacaaaugcccucauaucacagaaguugagccagaagacauugauuguuggugcaacuuaacuucaaccugggugacauaugggaccuguaaucaggcaggagagcaccgccgagacaagcguaguguagcccuggcgccgcaugugggcaugggucuagauacuagaacacaaaccuggaugagcgcugagggggccuggaggcaggucgaaaaaguggagacgugggcacuccggcaccccggauucacuauccuggcccuuuuucuggcucauuacauuggcaccuccuugacacagaagguugugaucuucauacuccugaugcuggucacuccuucuaugaccaugcgcugcgugggcguagggaacagagacuuuguugaaggacucucgggugcaacauggguggaugucguguuagagcacggcgggugugugaccacgauggccaagaauaaaccaacucuggacaucgagcuucagaagacagaagcuacccaauuggccacucugaggaaacuaugcauugagggaaagaucacaaacauuaccacggauucacggugucccacccagggcgaagcgacacucccugaggaacaggaccagaauuaugucugcaaacacacuuacguugaucgcgguugggggaacggauguggccuguucggcaaggggagccuugugaccugcgcaaaguuucaaugccuggagccaaucgagggaaaaguagugcaguaugaaaauuugaaguacacagucauaauuacugugcauaccggugaccagcaccagguuggcaacgagacacaaggggugaccgccgaaaucacuccccaggcuaguacgacagaggccauucucccugaauauggaacccugggcuuagaguguuccccacgaacuggucuggacuucaaugagaugauccuccuuaccaugaaaaacaaggcauggaugguccauagacagugguuuuucgaucugccguugcccuggacaucuggggcuaccacugaaacaccuacguggaauaggaaagagcuacuggugaccuuuaagaacgcccacgcgaaaaagcaagaaguaguugugcucggcagccaggagggagccaugcacacugcacugacaggcgcuaccgaaauccaaaauuccgggggaacaucaauuuucgccggucaucuuaagugccggcugaaaauggacaaguuggagcucaaaggcaugaguuacgcuauguguacuaacaccuuuguccugaagaaagaggugagcgaaacgcagcacgggaccauauuaaucaaggucgaguacaagggagaagaugugccaugcaaaauucccuucucuacagaggacggccaggguaaggcccauaacgggcgucugaucacugcaaauccuguugugaccaaaaaggaggaaccaguaaacauagaggccgaacccccguucggcgaguccaauauugucaucggaaucggcgauaacgcucuaaaaauuaauugguauaagaaggggucaagcaucggaaaaauguuugaagcgacagcacgcggugccagaaggauggcuauucucggcgacacugccugggauuucgggagugugggaggcguucugaacucucuugguaagauggugcaccagauauuuggguccgcauacaccgccuuguucagcggcgucucgugggugaugaaaaucggaauuggcguacugcucacguggaucgggcuuaauucuaagaacacauccaugucauuuaguuguaucgcuauuggaauaaucacccuguaucugggcgccgugguucaggca

SEQ ID NO: 1818 - RNA, 2019 nt, Artificial Sequence
  derived and/or modified CDS sequence (opt3) from DENV-3 Consensus__SSc-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaggguaaggcucauaacgggcgucuuauaaccgcgaauccaguugugacuaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggcc

SEQ ID NO: 1819 - RNA, 1056 nt, Artificial Sequence
  derived and/or modified CDS sequence (opt3) from DENV-3 Consensus__NS1
gacaugggcugcgugaucaacuggaaggggaaagagcugaaguguggaagcgguauuuucgucaccaaugaaguucacacauggacugagcaguacaaauuucaagccgauucccccaagagacucgcuacggcaauagccggcgcgugggaaaacggggugugcggaaucaggucuaccacacggauggagaaucuucuguggaaacagauugcuaacgaauugaauuauaucuuaugggagaacaauauuaagcugacuguaguggucggcgacaucauaggugugcuagagcaggggaagcgcacccucacaccucagccaauggaacugaaauacucauggaagaccuggggaaaagccaagaucguuacugcagagacacaaaacaguagcuucauuaucgauggcccgaauacccccgaauguccuuccgugucucgagccuggaacgucugggagguggaggacuauggcuuugggguauucacgacuaauauuuggcuuaaacugcgugaaguuuacacccaguugugcgaucauagacucaugucggcugcagugaaggacgagagggccguccacgcugauaugggauauuggaucgaaucacagaagaacgguagcuggaaacuggagaaggccagucugauagaagugaaaacauguacuuggccaaagucccauacccucuggucuaauggcguguuagagagcgacaugauuauccccaaaucccuggcggggccuauuucacagcacaaccaucggccaggauaccacacacaaaccgcaggccccuggcaccuugguaaguuggagcuggauuuuaauuauugcgaagggacgacugucguuaucacagagaacuguggaacccgcggcccuagucuaagaacuacaaccgugagcggcaaacucauccaugaauggugcuguaggucuugcacgcugccaccgcuucgguacaugggggaggacggauguugguacgguauggaaauucgccccauauccgagaaggaggaaaacaugguaaagucacuggugagcgcc

SEQ ID NO: 1820 - RNA, 1857 nt, Artificial Sequence
  derived and/or modified CDS sequence (opt3) from DENV-3 Consensus__NS3
agcggcgugcugugggacguccccuccccuccagagacccagaaggccgaacucgaggaagggguuuacagaaucaaacaacagggaauuuucgguaagacacaggugggcguaggggugcagaaagagggagucuuucacacuauguggcaugugacgaggggcgcuguucuuaccuauaacgguaagcggcuggaaccgaauugggcaucugugaaaaaggauuugauaucauacgggggaggcuggcgcuuaagugcccaauggcagaagggcgaggagguccaggugaucgcgguagaacccgggaaaaacccuaagaauuuccagacaaugccaggaacuuuucaaaccacaaccggugagauuggcgcuaucgcccuggacuucaaacccgggacuagcggauccccuauuaucaaccgagaaggcaagguugugggucuauaugggaauggagucgugaccaaaaacggcggcuacgugucugggauagcacagacaaaugccgagccagauggacccacgccugagcucgaagaggaaauguuuaagaagcguaaccugacuaucauggaccuucacccagguucgggcaaaaccagaaaguaucugccggcuauugucagggaggcaaucaaacggcgcuugagaacacucauucuggcccccacuaggguuguggcugccgaaauggaggaggcgcugaaggggcucccuauccgguaccagaccacagcaaccaaaucagaacauacgggacgcgagauaguagauuuaaugugccacgccacuuucacaaugcgacugcuuagcccagugagaguccccaauuauaacuugauuaucauggacgaagcucauuuuaccgauccugccaguauugcagcuaggggcuacaucuccacucggguggguaugggggaggccgcggccaucuucaugacagcaaccccacccggcacggcugacgccuuuccgcagucuaaugcuccuauucaagaugaggaacgugacauacccgagcgcagcuggaacuccggaaaugaauggaucaccgauuucgccggcaagacaguuugguuugugccaucaauuaaagcagggaacgacaucgccaauugucugagaaagaacggaaagaaagucauacagcuaaguaggaagacuuucgauaccgaguaccagaaaacaaagcucaacgacugggacuuugugguaacuaccgauauuagcgaaaugggugcuaauuucaaagcggaccggguuaucgauccucgacgcugccugaagcccgugauccuuacagacggcccagagagagucauucuggcagggcccaugccugugaccgccgcuucugccgcacaaaggcggggacgcgucggcagaaacccacagaaggaaaaugaucaguauaucuucacuggucagccguugaacaaugacgaggaucacgcccacuggacggaggcuaaaaugcuccuggacaacauuaauacacccgaagggauaaucccugccuuauuugagccagaaagggagaaguccgcagcgauugauggcgaguaccgucugaaaggagaaucacggaagaccuucguggagcucaugcgaagaggcgaccuucccguuuggcuggcucauaaaguggccagcgaagggaucaaguauacugauaggaagugguguuuugacggacaacgcaacaaucagaucuuggaggaaaacauggacguagagauuuggaccaaagagggugaaaagaaaaagcuacggccuagauggcuggaugcaaggacauacagugacccacucgcccugaaagaguucaaggaauuugcugccggccgcaag

SEQ ID NO: 1821 - RNA, 2319 nt, Artificial Sequence
  derived and/or modified CDS sequence (opt3) from DENV-3 Consensus__C-prME
augaacaaucagagaaagaaaaccggcaagcccagcaucaacaugcugaaaagggugcggaaucgcgucuccacagggucucaacucgccaagcgauucucaaaaggacuucugaacggucagggcccuaugaaguugguuauggcuuuuauugcauucuuacguuuucuggccauaccaccgacugcgggggugcuagcuagauggggaacguucaagaaaaguggcgccaucaagguacucaaagguuuuaagaaagagauuagcaauaugcuguccaucauuaacaagaggaagaaaaccucucuuugccugaugaugaucuugcccgcagcccucgcuuuccaccugacaucgcgggacggggaaccucgcaugauagugggaaagaaugagagaggcaaaucacugcucuuuaagacugcaagcggcaucaacauguguaccuuaauugccauggaucugggggaaaugugcgacgauacagucaccuacaaauguccacauaucacugagguggaacccgaggacauugauugcugguguaaucuuacaaguaccuggguuacguauggaacuugcaaccaggcuggugagcacaggcgggacaagcgcuccguggccuuggcgccucaugucggcauggggcuggauacccgaacacagacuuggaugucugcagaaggagccuggagacaaguggagaaaguagaaaccugggcucuaaggcacccaggcuucacaauccucgcccuguuucuugcacauuacauagguaccagccugacgcagaagguugugauuuucaucuugcucaugcuggucacucccuccaugacaaugcggugugugggggugggaaaucgugacuuugucgagggcuuaucaggcgcuaccuggguugaugugguacuggagcacgggggaugcgugacuacaauggccaagaacaaaccuacccucgacauugaacuucagaagacggaggcgacccagcuggccacauugcgcaaacuauguaucgaagguaagaucacuaauauuaccacagauaguagaugcccaacucaaggcgaggcaacccugccggaagaacaggaccagaacuaugucuguaaacacacauacguggauaggggguggggaaauggcugcggucucuucgggaagggcagccugguuaccugcgcuaaguuucagugucuugagcccauagaaggaaaagugguccaauaugagaaccugaaguacacugugaucauuacgguacauacaggcgaccagcaccagguugggaacgaaacccaaggagugacugccgagaucaccccucaggcuucuacaaccgaagccauauugccagaguaugguacucucggccuggagugcucaccccggacaggguuagacuucaaugaaaugauucugcuaacgaugaaaaacaaggcauggaugguccaucgacagugguucuuugaucucccucugccauggaccuccggagccacuacagagacccccacauggaaucgcaaagaacuuuuggugacuuucaagaacgcucacgcgaagaaacaggaggucgugguucugggcagccaagaaggugcaaugcacaccgcccucacgggggcuaccgagauccagaauaguggcggaacaucuaucuuugccggccaucugaaguguagacuuaaaauggacaagcuggaguugaaagggauguccuacgcaaugugcacuaacaccuucgugcucaagaaggaaguaagcgagacacagcacggaacuauucugaucaaagucgaauacaagggugaggaugugccguguaaaauuccuuuuucgaccgaggacggccaggggaaggcccauaauggaagguuaauaacggcuaaccccguugugacuaaaaaggaggagccagucaauaucgaagccgagccucccuucggcgaaucuaacauugugaucgguaucggggauaaugcacugaaaauuaacugguauaagaagggcuccucaauaggaaaaauguuugaggcgaccgcucggggcgcccgcagaauggcaauccuaggggacacugccugggauuucggaaguguaggcggugugcucaauagccuggggaagaugguucaccaaauuuuuggauccgcuuacacagcccuuuucucuggcgucagcugggugaugaaaaucgguauuggcguguugcugaccuggaucgggcucaacucaaagaauacaaguauguccuuuagcugcauagcaaucggaauuaucacccuguauuuaggcgcugucguucaggcc

SEQ ID NO: 1822 - RNA, 45 nt, Artificial Sequence
  derived and/or modified CDS sequence (opt3) from DENV-3 Consensus__SSc
augaccagccugugccucaugaugauccuucccgccgcucuggca

SEQ ID NO: 1823 - RNA, 57 nt, Artificial Sequence
  derived and/or modified CDS sequence (opt3) from DENV-3 Consensus__SSopt
augaagagaaagaaaaccagccugugccucaugaugauccuucccgccgcucuggca

SEQ ID NO: 1824 - RNA, 57 nt, Artificial Sequence
  derived and/or modified CDS sequence (opt3) from DENV-3 Consensus__SSm
augacccagaagguggucaucuucauucugcucaugcuuguuacacccagcaugacu

SEQ ID NO: 1825 - RNA, 1482 nt, Artificial Sequence
  derived and/or modified CDS sequence (opt3) from DENV-3 Consensus__E
augagaugcgugggcgucgggaacagggacuucguugagggacugagcggugccaccuggguggauguagugcucgaacacggcgggugugucacaacuauggcuaagaauaaacccacgcuugacaucgagcugcagaagaccgaagcaacacaauuggccacuuuacggaaacugugcauugagggaaagauaaccaacaucacaaccgauucccgcuguccuacucagggcgaagcgacacuaccagaggagcaggaccagaauuacgugugcaaacauaccuauguugaucgagguugggggaacggauguggccucuuuggcaaggggucucuggugacgugcgcuaaguuccaaugucuugaaccgauugagggaaaagucgugcaguacgaaaaucugaaguauacuguaaucauuaccguucacacaggugaccagcaucaggugggcaacgagacucaaggggucaccgccgagaucacaccccaggcaucaaccacggaagccauauugccugaguacggaacucucggccuggaaugcaguccacguacaggucuggauuuuaaugagaugauccucuuaaccaugaaaaacaaggcuuggauggugcacagacagugguucuuugaccugccccuuccuuggacuagcggggcaacaaccgaaacgccaaccuggaauaggaaagaguugcuggugacauucaagaacgcccaugcuaagaaacaggaggucguugugcuaggaucccaagaaggcgccaugcacacugcgcucaccggcgcaacagagauucaaaauucugggggaacuucgaucuuugccggucaccugaagugucggcuuaaaauggauaagcuggaauugaaaggcaugucauaugcuaugugcaccaacacauucguacucaagaaagaggugagcgaaacccagcaugggacuauucugaucaaggucgaguacaagggagaggacgugcccuguaaaauaccuuuuaguacggaagauggccaggguaaggcccacaaugggcgcuuaauuacagcaaacccaguugugaccaaaaaggaggaaccggucaauaucgaggcugaacccccuuucggcgaguccaacauugugaucggaaucggcgacaacgcccugaaaauuaauugguauaagaaggggucuagcauaggaaaaauguuugaggcgacugccagaggugcaaggcggauggcuauccucggcgauaccgccugggacuucggguccguaggaggcguucuuaacucacuggguaagauggugcaucagauuuuugggagugcuuacacagccuuguucagcggcgucucuugggugaugaaaaucggaauaggcguccuacugaccuggauugggcucaauuccaagaacacuucaaugagcuucaguugcaucgcaaucggaauuaucacacuguaccuuggugccgugguucaggcuuga

SEQ ID NO: 1826 - RNA, 1176 nt, Artificial Sequence
  derived and/or modified CDS sequence (opt3) from DENV-3 Consensus__EdelTM-variant (aa1-392)
augagaugcgugggcgucgggaacagggacuucguugagggacugagcggugccaccuggguggauguagugcucgaacacggcgggugugucacaacuauggcuaagaauaaacccacgcuugacaucgagcugcagaagaccgaagcaacacaauuggccacuuuacggaaacugugcauugagggaaagauaaccaacaucacaaccgauucccgcuguccuacucagggcgaagcgacacuaccagaggagcaggaccagaauuacgugugcaaacauaccuauguugaucgagguugggggaacggauguggccucuuuggcaaggggucucuggugacgugcgcuaaguuccaaugucuugaaccgauugagggaaaagucgugcaguacgaaaaucugaaguauacuguaaucauuaccguucacacaggugaccagcaucaggugggcaacgagacucaaggggucaccgccgagaucacaccccaggcaucaaccacggaagccauauugccugaguacggaacucucggccuggaaugcaguccacguacaggucuggauuuuaaugagaugauccucuuaaccaugaaaaacaaggcuuggauggugcacagacagugguucuuugaccugccccuuccuuggacuagcggggcaacaaccgaaacgccaaccuggaauaggaaagaguugcuggugacauucaagaacgcccaugcuaagaaacaggaggucguugugcuaggaucccaagaaggcgccaugcacacugcgcucaccggcgcaacagagauucaaaauucugggggaacuucgaucuuugccggucaccugaagugucggcuuaaaauggauaagcuggaauugaaaggcaugucauaugcuaugugcaccaacacauucguacucaagaaagaggugagcgaaacccagcaugggacuauucugaucaaggucgaguacaagggagaggacgugcccuguaaaauaccuuuuaguacggaagauggccaggguaaggcccacaaugggcgcuuaauuacagcaaacccaguugugaccaaaaaggaggaaccggucaauaucgaggcugaacccccuuucggcgaguccaacauugugaucggaaucggcgacaacgcccugaaaauuaauugguauaagaag

SEQ ID NO: 1827 - RNA, 1269 nt, Artificial Sequence
  derived and/or modified CDS sequence (opt3) from DENV-3 Consensus__EdelTM-variant (aa1-422)
augagaugcgugggcgucgggaacagggacuucguugagggacugagcggugccaccuggguggauguagugcucgaacacggcgggugugucacaacuauggcuaagaauaaacccacgcuugacaucgagcugcagaagaccgaagcaacacaauuggccacuuuacggaaacugugcauugagggaaagauaaccaacaucacaaccgauucccgcuguccuacucagggcgaagcgacacuaccagaggagcaggaccagaauuacgugugcaaacauaccuauguugaucgagguugggggaacggauguggccucuuuggcaaggggucucuggugacgugcgcuaaguuccaaugucuugaaccgauugagggaaaagucgugcaguacgaaaaucugaaguauacuguaaucauuaccguucacacaggugaccagcaucaggugggcaacgagacucaaggggucaccgccgagaucacaccccaggcaucaaccacggaagccauauugccugaguacggaacucucggccuggaaugcaguccacguacaggucuggauuuuaaugagaugauccucuuaaccaugaaaaacaaggcuuggauggugcacagacagugguucuuugaccugccccuuccuuggacuagcggggcaacaaccgaaacgccaaccuggaauaggaaagaguugcuggugacauucaagaacgcccaugcuaagaaacaggaggucguugugcuaggaucccaagaaggcgccaugcacacugcgcucaccggcgcaacagagauucaaaauucugggggaacuucgaucuuugccggucaccugaagugucggcuuaaaauggauaagcuggaauugaaaggcaugucauaugcuaugugcaccaacacauucguacucaagaaagaggugagcgaaacccagcaugggacuauucugaucaaggucgaguacaagggagaggacgugcccuguaaaauaccuuuuaguacggaagauggccaggguaaggcccacaaugggcgcuuaauuacagcaaacccaguugugaccaaaaaggaggaaccggucaauaucgaggcugaacccccuuucggcgaguccaacauugugaucggaaucggcgacaacgcccugaaaauuaauugguauaagaaggggucuagcauaggaaaaauguuugaggcgacugccagaggugcaaggcggauggcuauccucggcgauaccgccugggacuucggguccuga

SEQ ID NO: 1828 - RNA, 1260 nt, Artificial Sequence
  derived and/or modified CDS sequence (opt3) from DENV-3 Consensus__EdelTM-variant (aa1-419)
augagaugcgugggcgucgggaacagggacuucguugagggacugagcggugccaccuggguggauguagugcucgaacacggcgggugugucacaacuauggcuaagaauaaacccacgcuugacaucgagcugcagaagaccgaagcaacacaauuggccacuuuacggaaacugugcauugagggaaagauaaccaacaucacaaccgauucccgcuguccuacucagggcgaagcgacacuaccagaggagcaggaccagaauuacgugugcaaacauaccuauguugaucgagguugggggaacggauguggccucuuuggcaaggggucucuggugacgugcgcuaaguuccaaugucuugaaccgauugagggaaaagucgugcaguacgaaaaucugaaguauacuguaaucauuaccguucacacaggugaccagcaucaggugggcaacgagacucaaggggucaccgccgagaucacaccccaggcaucaaccacggaagccauauugccugaguacggaacucucggccuggaaugcaguccacguacaggucuggauuuuaaugagaugauccucuuaaccaugaaaaacaaggcuuggauggugcacagacagugguucuuugaccugccccuuccuuggacuagcggggcaacaaccgaaacgccaaccuggaauaggaaagaguugcuggugacauucaagaacgcccaugcuaagaaacaggaggucguugugcuaggaucccaagaaggcgccaugcacacugcgcucaccggcgcaacagagauucaaaauucugggggaacuucgaucuuugccggucaccugaagugucggcuuaaaauggauaagcuggaauugaaaggcaugucauaugcuaugugcaccaacacauucguacucaagaaagaggugagcgaaacccagcaugggacuauucugaucaaggucgaguacaagggagaggacgugcccuguaaaauaccuuuuaguacggaagauggccaggguaaggcccacaaugggcgcuuaauuacagcaaacccaguugugaccaaaaaggaggaaccggucaauaucgaggcugaacccccuuucggcgaguccaacauugugaucggaaucggcgacaacgcccugaaaauuaauugguauaagaaggggucuagcauaggaaaaauguuugaggcgacugccagaggugcaaggcggauggcuauccucggcgauaccgccugggacuga

SEQ ID NO: 1829 - RNA, 1155 nt, Artificial Sequence
  derived and/or modified CDS sequence (opt3) from DENV-3 Consensus__Edelaa101-107
augagaugcgugggcgucgggaacagggacuucguugagggacugagcggugccaccuggguggauguagugcucgaacacggcgggugugucacaacuauggcuaagaauaaacccacgcuugacaucgagcugcagaagaccgaagcaacacaauuggccacuuuacggaaacugugcauugagggaaagauaaccaacaucacaaccgauucccgcuguccuacucagggcgaagcgacacuaccagaggagcaggaccagaauuacgugugcaaacauaccuauguugaucgagguuuugggaagggaucucucgugacgugugcuaaguuccaaugccuggaaccgauugagggcaaagucgugcaguacgaaaaccuuaaguauacuguaaucauuaccguucacacaggcgaccagcaucagguggggaaugagacucaaggagucaccgccgagaucacaccccaggcaucaaccacggaagccauacugccugaguacgguacuuugggccucgaauguaguccacguacagggcuggauuuuaacgagaugauccugcucaccaugaaaaauaaggcuuggauggugcacagacagugguucuuugacuuaccccugccuuggacuagcggagcaacaaccgaaacgccaaccuggaacaggaaagagcuuuuggugacauucaagaaugcccaugcuaagaaacaggaggucguugugcugggcucccaagaaggugccaugcacacugcgcuaaccggggcaacagagauucagaacucuggaggcacuucgaucuuugccggccaccucaagugccggcugaaaauggauaaacuugaacugaaggggaugucauaugcuauguguaccaauacauucguauugaagaaagaggugagcgaaacccagcauggaacuauucucaucaaggucgaguacaagggugaggacgugcccugcaaaauaccuuuuaguacggaagauggccaagggaaggcccacaacggacgccugauuacagcaaauccaguugugaccaaaaaggaggaaccggucaacaucgaggcugaacccccuuucggcgaguccaauauugugaucgguaucggggacaacgccuuaaaaauuaacugguauaagaag

SEQ ID NO: 1830 - RNA, 1173 nt, Artificial Sequence
  derived and/or modified CDS sequence (opt3) from DENV-3 Consensus__EdelTM-variant (aa1-391)
augagaugcgugggcgucgggaacagggacuucguugagggacugagcggugccaccuggguggauguagugcucgaacacggcgggugugucacaacuauggcuaagaauaaacccacgcuugacaucgagcugcagaagaccgaagcaacacaauuggccacuuuacggaaacugugcauugagggaaagauaaccaacaucacaaccgauucccgcuguccuacucagggcgaagcgacacuaccagaggagcaggaccagaauuacgugugcaaacauaccuauguugaucgagguugggggaacggauguggccucuuuggcaaggggucucuggugacgugcgcuaaguuccaaugucuugaaccgauugagggaaaagucgugcaguacgaaaaucugaaguauacuguaaucauuaccguucacacaggugaccagcaucaggugggcaacgagacucaaggggucaccgccgagaucacaccccaggcaucaaccacggaagccauauugccugaguacggaacucucggccuggaaugcaguccacguacaggucuggauuuuaaugagaugauccucuuaaccaugaaaaacaaggcuuggauggugcacagacagugguucuuugaccugccccuuccuuggacuagcggggcaacaaccgaaacgccaaccuggaauaggaaagaguugcuggugacauucaagaacgcccaugcuaagaaacaggaggucguugugcuaggaucccaagaaggcgccaugcacacugcgcucaccggcgcaacagagauucaaaauucugggggaacuucgaucuuugccggucaccugaagugucggcuuaaaauggauaagcuggaauugaaaggcaugucauaugcuaugugcaccaacacauucguacucaagaaagaggugagcgaaacccagcaugggacuauucugaucaaggucgaguacaagggagaggacgugcccuguaaaauaccuuuuaguacggaagauggccaggguaaggcccacaaugggcgcuuaauuacagcaaacccaguugugaccaaaaaggaggaaccggucaauaucgaggcugaacccccuuucggcgaguccaacauugugaucggaaucggcgacaacgcccugaaaauuaauugguauaag

SEQ ID NO: 1831 - RNA, 2025 nt, Artificial Sequence
  derived and/or modified CDS sequence (opt3) from DENV-3 Consensus__SSc-prME
augaccagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaggguaaggcucauaacgggcgucuuauaaccgcgaauccaguugugacuaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccuga

SEQ ID NO: 1832 - RNA, 2025 nt, Artificial Sequence
  derived and/or modified CDS sequence (opt3) from DENV-3 Consensus__SSc-prME(F108S)
augaccagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucaguggcaaggggucccuggugacaugcgccaaguuccaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuucuacaaccgaggccauccucccagaauauggaacucuuggccuggagugcagcccgcgaaccgguuuggacuuuaaugagaugauccuacugacaaugaaaaacaaggcguggaugguccauagacagugguucuuugaucucccccugccuuggaccuccggggccacuacagaaacgccaaccuggaauaggaaagagcuucuggugacuuucaagaacgcacacgcuaaaaagcaagaaguaguuguguugggcucacaggagggagccaugcacacagcucucaccggcgccacagaaauucagaauagugggggaacuagcauauuugcaggucaucugaagugucgguuaaaaauggacaagcuggagcuaaaaggcaugucuuacgccaugugcaccaacacguucguccucaagaaagagguguccgaaacccagcacgggacaauccugauuaaggucgaguacaagggagaagaugugcccuguaaaaucccuuuuucaacugaggacggccaagguaaggcucauaacgggcgucuuauaaccgcgaauccaguugugacuaaaaaggaggaacccguaaacauugaggcagaaccgccuuucggcgagagcaauaucgucaucggaauuggcgauaacgccuugaaaaucaauugguauaagaaggggaguucuauuggaaaaauguucgaagcuacagcccgcggugcaagaaggauggccauacugggcgacaccgcuugggauuuuggguccgugggaggcguucucaacagccuggguaagauggugcaccagaucuucgggucggccuacacggcacuguuuucuggcgucuccugggugaugaaaauuggaaucggcguacuuuugacauggaucgggcucaauucaaagaacaccaguaugagcuucuccugcauugcgauaggaaucauuacucuguauuuaggcgcugugguucaggccuga

SEQ ID NO: 1833 - RNA, 2025 nt, Artificial Sequence
  derived and/or modified CDS sequence (opt3) from DENV-3 Consensus__SSc-prME(R186L)
augaccagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccguugaccggucuagacuucaaugagaugauccugcucacaaugaaaaacaaggcguggaugguccaucgacagugguuuuucgaucugccccuuccuuggaccagcggggccacuacagaaacgccaaccuggaauagaaaagagcuguuggugacuuuuaagaacgcacacgcuaaaaagcaagaaguaguugugcucggcucccaggagggagccaugcacacagcucugaccggcgccacagaaauucaaaauucagggggaacaaguauauucgcaggucauuuaaaguguaggcugaaaauggacaagcuagagcucaaaggcaugagcuacgccaugugcaccaacacguuuguccugaagaaagaggugucugaaacccagcacgggacaauccuuauuaaggucgaguacaagggagaagaugugcccuguaaaaucccuuucuccacugaggacggccaggguaaggcucauaacgggcgguugauaaccgcgaauccaguugugacuaaaaaggaggaacccguaaacauugaggcagaaccgccuuucggcgagucaaauaucgucaucggaauuggcgauaacgcccugaaaaucaauugguauaagaaggggagcaguauuggaaaaauguuugaagcuacugcccguggugcacgcagaauggccauacucggcgacaccgcuugggauuucgggucugugggaggcguucugaacucccuugguaagauggugcaccagaucuuugggagcgccuacacggcacuguucucgggcgucucuugggugaugaaaauuggaaucggcguauugcucacauggaucggguuaaauuccaagaacaccucaaugaguuuuagcugcauugcgauaggaaucauuacucuguaucugggcgcugugguucaggccuga

SEQ ID NO: 1834 - RNA, 2025 nt, Artificial Sequence
  derived and/or modified CDS sequence (opt3) from DENV-3 Consensus__SSc-prME(A265T)
augaccagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcacaacugaaauucaaaauucagggggaaccaguauauucgccggucaucugaagugucgguuaaaaauggacaagcuggagcuaaaaggcaugagcuacgcaaugugcacgaacaccuuuguccucaagaaagaggugucugaaacacagcacgggacuauccugauuaaggucgaguacaagggagaagaugugcccuguaaaaucccuuucuccaccgaggacggccaggguaaggcccauaacgggcgucuuauaacagcuaauccaguugugacuaaaaaggaggaacccguaaacauugaggcggaaccgccuuucggcgagucaaauaucgucaucggaauuggcgauaacgcauugaaaaucaauugguauaagaaggggagcaguauuggaaaaauguuugaagccaccgcucgcggugccagaaggauggcaauacugggcgacacggccugggauuucgggucugugggaggcguucucaacucccuggguaagauggugcaccagaucuuugggagcgcuuacacagcccuuuucucgggcgucucuugggugaugaaaauuggaaucggcguacuguugaccuggaucgggcucaauuccaagaacacuucaaugaguuuuagcugcauugcaauaggaaucauuacacuguauuuaggcgcggugguucaggcuuga

SEQ ID NO: 1835 - RNA, 2025 nt, Artificial Sequence
  derived and/or modified CDS sequence (opt3) from DENV-3 Consensus__SSc-prMEdelstem_TM-JEV
augaccagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaggguaaggcucauaacgggcgucuuauaaccgcgaauccaguugugacuaaaaaggaggaacccguaaacauugaggcagaaccgccuuucggcgagucaaauaucgucaucggaauuggcgauaacgccuugaaaaucaauugguauaagaaggggagcacucugggaaaggcuuuuaguaccacgcucaaaggugcccagcgccuggcagcccuuggcgacacagcuugggauuucgggucuauuggaggcguguuuaacuccauagguagagccguucaccagguguucgggggcgcauuuaggacccuguucggaggcaugagcuggaucacucagggguugaugggagcgcuccuguuauggaugggcgucaaugcucgggaccgaucgauugcccuggcauuucuagccacagguggggugcucguauuccuggcuaccaacgugcaugccuga

SEQ ID NO: 1836 - RNA, 1326 nt, Artificial Sequence
  derived and/or modified CDS sequence (opt3) from DENV-3 Consensus__SSm-EdelTM
augacccagaagguggucaucuucauucugcucaugcuuguuacacccagcaugacuaugagaugcgugggcguagggaacagggacuuuguggagggacuguccggugccacgugggucgaugugguuuuggaacacggcgggugugugaccacaauggcuaaaaauaagccuacuuuagacauagagcugcagaaaaccgaagcaacacagcuagccacccuccggaagcugugcaucgagggaaaaauuacuaacaucacaaccgauucucgcuguccaacgcagggcgaagcgacucuuccggaggagcaggaccaaaauuacgucugcaagcauaccuauguggaucgagguugggggaacggauguggccuguucggcaaggggucauugguaacaugcgcuaaauuucagugucucgaacccauugagggaaagguugugcaguacgaaaaucugaaauauacugucaucauaaccgugcacacaggugaccagcaucaagugggcaacgagacccagggggucacggccgagaucacuccucaggcaaguacaaccgaagccauucugccagaguacggaacucucggcuuagaaugcagcccccguacaggucuggauuucaaugagaugauccuuuugaccaugaagaacaaggcuuggaugguucacagacagugguuuuucgaccugccucuaccauggacguccggggcaaccacagaaacucccaccuggaauaggaaagagcuccuggugacauuuaagaacgcccaugcuaaaaagcaagagguagugguccuuggaucucaggaaggcgccaugcacacugcgcugaccggcgcaacagagauucaaaauucagggggaaccucgaucuucgccggucacuugaaaugucggcucaagauggauaaacuggaauuaaagggcaugagcuaugcuaugugcacuaacacguuugugcugaaaaaggagguuagugaaacacaacaugggaccauacucauuaagguggaguacaaaggagaggacgucccuuguaagaucccauucuccacugaagauggccaggguaaagcccacaaugggcgccuuauuaccgcaaacccggugguaacaaagaaagaggaacccguuaauaucgaggcugaaccuccauuuggcgagucuaacaucgugauuggaauaggcgacaacgcccugaagaucaauugguauaagaaagggagcuccauuggaaagauguucgaggcgaccgccagaggugcaaggcggauggcuaucuugggcgauacugccugggacuuugggucauga

SEQ ID NO: 1837 - RNA, 2373 nt, Artificial Sequence
  derived and/or modified CDS sequence (opt3) from DENV-3 Consensus__C-P2A-SSc-prME
augaacaaucagagaaagaaaaccggcaagcccagcaucaacaugcugaaaagggugcggaaucgcgucuccacagggucucaacucgccaagcgauucucaaaaggacuucugaacggucagggcccuaugaaguugguuauggcuuuuauugcauucuuacguuuucuggccauaccaccgacugcgggggugcuagcuagauggggaacguucaagaaaaguggcgccaucaagguacucaaagguuuuaagaaagagauuagcaauaugcuguccaucauuaacaagaggaagaaaaauuucgaccuucugaaguuggcaggggauguggaaucuaaccccggaccuaccucgcucugccugaugaugauccugccagccgcucucgcauuucacuuaacaucacgggacggcgagccccgcaugauagucggcaaaaaugaaagagggaaaagccugcuuuucaaaacugccaguggaaucaacauguguaccuugauugcuauggaucugggugagaugugcgacgauacagugaccuacaaguguccucauaucacugaaguugagccagaggacauugauugcugguguaaucuaacauccaccugggugacguauggcacuugcaaccaggccggggaacacaggcgggacaaacgcucugucgcgcucgcaccccaugugggaaugggccuggauacccgaacacagacuuggaugagcgccgagggugcuuggagacaaguagaaaagguugagaccugggcccuuaggcacccuggguuuacaauccuggcauuguuccucgcucauuacauaggaaccucccugacgcagaagguggucauuuuuaucuuacugaugcucgugacuccaucaaugacaaugcggugugugggcgucggcaaucgugacuucguugaggggcuuaguggagccaccuggguggauguagugcuggaacacgguggcugcgucacuacaauggcgaaaaacaagccgaccuuggacauugagcuacagaaaacggaagccacccagcuggcaacacuccgcaagcuguguaucgaggggaaaaucacuaauauuaccacagauagcagaugccccacucaaggagaagcuacccuuccugaggagcaggaccagaacuauguguguaagcacacauacguugacaggggcugggguaacgggugcggccuguuuggaaagggcucuuuggugaccugcgccaaauuccagugucucgaaccaauagaggggaaggucgugcaauaugaaaaucugaaauacacuguaaucauuacgguucauacaggagaucagcaccagguggguaacgagacccaaggcgucacugcugaaaucacaccccaggccuccaccaccgaggcaauauuaccugaguaugggacucugggacuagaaugcucaccacggacaggccucgacuucaaugagaugauucugcuuacgaugaagaacaaagccuggauggugcaucgacagugguuuuucgauuugccccugccguggaccagcggugcuacuacagaaaccccuacauggaaucgcaaggagcuccuggucacuuuuaagaacgcgcacgcaaagaagcaggaagugguugugcuugggagucaagagggcgccaugcacaccgcucugacgggagccaccgagauccaaaauucuggcgggacauccaucuucgcaggacauuugaaauguagacucaagauggacaaacuggaauuaaaggguaugagcuacgccaugugcacuaacaccuuuguacugaagaaagaggucucggaaacacagcacggcacuauucuaaucaagguggaguacaaaggggaggauguucccuguaagauuccauucucuaccgaagacggacagggcaaagcucauaaugguaggcucauaacggccaacccuguggucacaaagaaagaggaacccgugaauaucgaggcagaaccacccuuuggggaguccaacauuguaaucggcaucggagauaaugcgcugaagauuaacugguauaagaaaggcucaaguauagggaagauguucgaggcuaccgcccggggagcacgcagaauggccauccuuggcgacacugcuugggauuuugguagcguugggggaguguugaacucccugggcaaaaugguccaccagauuuucgguucugccuacacagcacucuuuagcggcgugucaugggugaugaagaucgggauuggaguccuguuaaccuggaucggccugaauaguaaaaacacuuccaugagcuucucuugcauagcuaucgggauuaucacccuuuauuugggagccguugugcaggcguga

SEQ ID NO: 1838 - RNA, 2037 nt, Artificial Sequence
  derived and/or modified CDS sequence (opt3) from DENV-3 Consensus__SSopt-prME
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgagaaccgguuuggacuucaaugagaugauccuacugacaaugaagaacaaagcguggaugguccauaggcagugguuuuucgaucucccccugccuuggaccagcggggccacuacagaaacgccaaccuggaaucggaaggagcuucuggugacuuuuaagaacgcacacgcuaaaaagcaagaaguaguuguguugggcucccaggagggagccaugcacacagcucucaccggcgccacagaaauucagaauagugggggaacuucaauauucgcaggucaucugaaaugucguuuaaagauggacaaacuggagcuaaagggcaugagcuacgccaugugcaccaacacguuuguccucaagaaagaggugucugaaacccagcacgggacaauccugauuaaggucgaguacaaaggagaagaugugcccuguaagaucccuuucuccacugaggacggccaagguaaagcucauaacgggcgccuuauaaccgcgaauccaguugugacaaagaaggaggaacccguaaacauugaggcagaaccgccuuucggcgagucaaauaucgucaucggaauuggcgauaacgccuugaaaaucaauugguauaagaaagggagcaguauuggaaagauguuugaagcuacugccagaggugcaaggcggauggccauacugggcgacaccgcuugggauuucgggucugugggaggcguucucaacucccuggguaaaauggugcaccagaucuuugggagcgccuacacggcacuuuucucgggcgucucuugggugaugaagauuggaaucggcguacuguugacauggaucgggcucaauuccaagaacaccucaaugaguuuuagcugcauugcgauaggaaucauuacucuguauuuaggcgcugugguucaggccuga

SEQ ID NO: 1839 - RNA, 2037 nt, Artificial Sequence
  derived and/or modified CDS sequence (opt3) from DENV-3 Consensus__SSopt-prME(F108S)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucaguggcaaggggucccuggugacaugcgccaaauuccaauguuuagagcccauagagggaaagguagugcaguaugaaaaucugaaauacacugucauuaucaccgugcauacaggugaccagcaccagguuggcaacgagacccaaggggugacugcagaaauuacgccucaggcuucuacaaccgaggccauccucccagaauauggaacucuuggccuggagugcagcccgagaaccgguuuggacuuuaaugagaugauccuacugacaaugaagaacaaagcguggaugguccauaggcagugguucuuugaucucccccugccuuggaccuccggggccacuacagaaacgccaaccuggaaucggaaggagcuucuggugacuuucaagaacgcacacgcuaaaaagcaagaaguaguuguguugggcucacaggagggagccaugcacacagcucucaccggcgccacagaaauucagaauagugggggaacuagcauauuugcaggucaucugaaaugucguuuaaagauggacaaacuggagcuaaagggcaugucuuacgccaugugcaccaacacguucguccucaagaaagagguguccgaaacccagcacgggacaauccugauuaaggucgaguacaaaggagaagaugugcccuguaagaucccuuuuucaacugaggacggccaagguaaagcucauaacgggcgccuuauaaccgcgaauccaguugugacaaagaaggaggaacccguaaacauugaggcagaaccgccuuucggcgagagcaauaucgucaucggaauuggcgauaacgccuugaaaaucaauugguauaagaaagggaguucuauuggaaagauguucgaagcuacugccagaggugcaaggcggauggccauacugggcgacaccgcuugggauuuuggguccgugggaggcguucucaacagccuggguaaaauggugcaccagaucuucgggucggccuacacggcacuguuuucuggcgucuccugggugaugaagauuggaaucggcguacuuuugacauggaucgggcucaauucaaagaacaccaguaugagcuucuccugcauugcgauaggaaucauuacucuguauuuaggcgcugugguucaggccuga

SEQ ID NO: 1840 - RNA, 2037 nt, Artificial Sequence
  derived and/or modified CDS sequence (opt3) from DENV-3 Consensus__SSopt-prME(H27N)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagaauggcgggugcgugacgacuauggcgaaaaacaagcccacacuagacauugagcuccagaaaaccgaagcaacucaacuggccacacuucggaagcuguguaucgagggaaagauuaccaauaucacgaccgauagccgcugcccuacacagggcgaagcuacuuugccagaggaacaggaccagaacuaugucuguaaacacaccuacguugaucgagguugggggaauggaugcggccucuucggcaaggggagucuggugacaugcgccaaauuucaauguuuagagcccauagagggaaagguagugcaguaugaaaaccugaaauacacugucauuaucaccgugcacacaggugaccagcaucagguuggcaaugagacccaaggggugacugcagaaauuacgccucaggcuuccacaaccgaggccauccucccagaauauggaacucuuggccuggagugcucuccgagaaccgguuuggacuucaacgagaugauccuacugacaaugaagaauaaagcguggaugguccacaggcagugguuuuucgaucucccccugccuuggaccagcggggccacuacagaaacgccaaccuggaaccggaaggagcuucuggugacuuuuaagaaugcacaugcuaaaaagcaagaaguaguuguguugggcucccaggagggagccaugcacacagcucucaccggcgccacagaaauucagaacucagggggaaccaguauauucgcaggucaccugaaaugucguuuaaagauggacaaacuggagcuaaagggcaugagcuacgccaugugcacuaacacguuuguccucaagaaagaggugucugaaacccagcaugggacaauccugauuaaggucgaguacaaaggagaagaugugcccuguaagaucccuuucuccacugaggacggccaagguaaagcucacaaugggcgccuuauaaccgcgaacccaguugugacaaagaaggaggaacccguaaauauugaggcagaaccgccuuucggcgagucaaacaucgucaucggaauuggcgauaaugccuugaaaaucaacugguauaagaaagggagcaguauuggaaagauguuugaagcuacugccagaggugcaaggcggauggccauacugggcgacaccgcuugggauuucgggucugugggaggcguucucaauucccuggguaaaauggugcaucagaucuuugggagcgccuacacggcacuuuucucgggcgucucuugggugaugaagauuggaaucggcguacuguugacauggaucgggcucaacuccaagaauaccucaaugaguuuuagcugcauugcgauaggaaucauuacucuguauuuaggcgcugugguucaggccuga

SEQ ID NO: 1841 - RNA, 2037 nt, Artificial Sequence
  derived and/or modified CDS sequence (opt3) from DENV-3 Consensus__SSopt-prME(T76I)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuauacagggcgaagcuacauugccagaggaacaggaccagaauuaugucuguaaacacacuuacguugaucgagguugggggaacggaugcggccucuucggcaaggggagucuggugaccugcgccaaauuucaauguuuagagcccauugagggaaagguagugcaguaugaaaaucugaaauacacagucaucauuacugugcauaccggugaccagcaccagguuggcaacgagacacaaggggugaccgcagaaaucacuccucaggcuuccacgacagaggccauccucccagaauauggaacccuuggccuggagugcucuccgagaacugguuuggacuucaaugagaugauucuacugaccaugaagaacaaagcguggaugguccauaggcagugguuuuucgaucucccccugccuuggacaagcggggccaccacugaaacaccaacguggaaucggaaggagcuucuggugaccuuuaagaacgcacacgcuaaaaagcaagaaguaguuguguugggcucccaggagggagccaugcacacugcucucacaggcgccaccgaaauacaaaauucagggggaacaaguaucuucgcaggucaucugaaaugucguuuaaagauggacaaacuggagcuaaagggcaugagcuacgccaugugcacuaacaccuuuguccucaagaaagaggugucugaaacgcagcacgggaccauucugaucaaggucgaguacaaaggagaagaugugcccuguaagauaccuuucuccacagaggacggccaggguaaagcucauaacgggcgccuuauuacugcgaauccaguugugaccaagaaggaggaacccguaaacaucgaggcagaaccgccuuucggcgagucaaauaucgucauuggaaucggcgauaacgccuugaaaauuaauugguauaagaaagggagcaguauaggaaagauguuugaagcuacagccagaggugcaaggcggauggccauccugggcgacacugcuugggauuucgggucugugggaggcguucucaacucccuggguaaaauggugcaccagauuuuugggagcgccuacaccgcacuuuucucgggcgucucuugggugaugaagaucggaaucggcguacuguugacguggauugggcucaauuccaagaacacaucaaugaguuuuagcugcauagcgaucggaauuaucacccuguauuuaggcgcugugguucaggccuga

SEQ ID NO: 1842 - RNA, 2037 nt, Artificial Sequence
  derived and/or modified CDS sequence (opt3) from DENV-3 Consensus__SSopt-prME(N89D)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccaggauuaugucuguaaacacaccuacguugaccgagguugggggaauggaugcggccucuucggcaaggggagucuggugacaugcgccaaauuucaauguuuagagcccauagagggaaagguagugcaguaugaaaaccugaaauacacugucauuaucaccgugcauacaggugaccagcaccagguuggcaaugagacccaaggggugacugcagaaauuacgccucaggcuuccacaaccgaggccauccucccagaauauggaacucuuggccuggagugcucuccgagaaccgguuuggauuucaacgagaugauccuacugacaaugaagaauaaagcguggaugguccauaggcagugguuuuucgaccucccccugccuuggaccagcggggccacuacagaaacgccaaccuggaaccggaaggagcuucuggugacuuuuaagaaugcacacgcuaaaaagcaagaaguaguuguguugggcucccaggagggagccaugcacacagcucucaccggcgccacagaaauucagaacucagggggaaccaguauauucgcaggucaucugaaaugucguuuaaagauggauaaacuggagcuaaagggcaugagcuacgccaugugcacuaauacguuuguccucaagaaagaggugucugaaacccagcacgggacaauccugauuaaggucgaguacaaaggagaagacgugcccuguaagaucccuuucuccacugaggauggccaagguaaagcucauaacgggcgccuuauaaccgcgaacccaguugugacaaagaaggaggaacccguaaauauugaggcagaaccgccuuucggcgagucaaacaucgucaucggaauuggcgacaaugccuugaaaaucaacugguauaagaaagggagcaguauuggaaagauguuugaagcuacugccagaggugcaaggcggauggccauacugggcgauaccgcuugggacuucgggucugugggaggcguucucaauucccuggguaaaauggugcaccagaucuuugggagcgccuacacggcacuuuucucgggcgucucuugggugaugaagauuggaaucggcguacuguugacauggaucgggcucaacuccaagaauaccucaaugaguuuuagcugcauugcgauaggaaucauuacucuguauuuaggcgcugugguucaggccuga

SEQ ID NO: 1843 - RNA, 2037 nt, Artificial Sequence
  derived and/or modified CDS sequence (opt3) from DENV-3 Consensus__SSopt-prME(Y96H)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacacccauguugaucgagguugggggaacggaugcggccucuucggcaaggggagucuggugacaugcgccaaauuucaauguuuagagcccauagagggaaagguagugcaguacgaaaaucugaaauauacugucauuaucaccgugcacacaggugaccagcaucagguuggcaacgagacccaaggggugacugcagaaauuacgccucaggcuuccacaaccgaggccauccucccagaauacggaacucuuggccuggagugcucuccgagaaccgguuuggacuucaaugagaugauccuacugacaaugaagaacaaagcguggaugguccacaggcagugguuuuucgaucucccccugccuuggaccagcggggccacuacagaaacgccaaccuggaaucggaaggagcuucuggugacuuuuaagaacgcacacgcuaaaaagcaagaaguaguuguguugggcucccaggagggagccaugcauacagcucucaccggcgccacagaaauucagaauagugggggaacuucaauauucgcaggucaccugaaaugucguuuaaagauggacaaacuggagcuaaagggcaugagcuaugccaugugcaccaacacguuuguccucaagaaagaggugucugaaacccagcaugggacaauccugauuaaggucgaguacaaaggagaagaugugcccuguaagaucccuuucuccacugaggacggccaagguaaagcucacaacgggcgccuuauaaccgcgaauccaguugugacaaagaaggaggaacccguaaacauugaggcagaaccgccuuucggcgagucaaauaucgucaucggaauuggcgauaacgccuugaaaaucaauugguacaagaaagggagcaguauuggaaagauguuugaagcuacugccagaggugcaaggcggauggccauacugggcgacaccgcuugggauuucgggucugugggaggcguucucaacucccuggguaaaauggugcaucagaucuuugggagcgccuauacggcacuuuucucgggcgucucuugggugaugaagauuggaaucggcguacuguugacauggaucgggcucaauuccaagaacaccucaaugaguuuuagcugcauugcgauaggaaucauuacucuguacuuaggcgcugugguucaggccuga

SEQ ID NO: 1844 - RNA, 2037 nt, Artificial Sequence
  derived and/or modified CDS sequence (opt3) from DENV-3 Consensus__SSopt-prME(K110E)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcgaggggagucuggugacaugcgccaaguuucaauguuuagagcccauagaaggaaaaguagugcaguaugagaaucugaaguacacugucauuaucaccgugcauacaggugaccagcaccagguuggcaacgaaacccaaggggugacugcagagauuacgccucaggcuuccacaaccgaagccauccucccagaguauggaacucuuggccuggagugcucuccgagaaccgguuuggacuucaaugaaaugauccuacugacaaugaaaaacaaggcguggaugguccauaggcagugguuuuucgaucucccccugccuuggaccagcggggccacuacagagacgccaaccuggaaucggaaagaacuucuggugacuuuuaagaacgcacacgcuaagaaacaagagguaguuguguugggcucccaggaaggagccaugcacacagcucucaccggcgccacagagauucaaaauucagggggaacaaguauauucgcaggucaucugaagugucguuuaaaaauggacaagcuggagcuaaaaggcaugagcuacgccaugugcaccaacacguuuguccucaagaaggaagugucugagacccagcacgggacaauccugauuaaagucgaauacaagggagaggaugugcccuguaaaaucccuuucuccacugaggacggccaggguaaggcucauaacgggcgccuuauaaccgcgaauccaguugugacuaaaaaggaggaacccguaaacauugaagcagagccgccuuucggcgaaucaaauaucgucaucggaauuggcgauaacgccuugaagaucaauugguauaaaaaggggagcaguauuggaaaaauguuugaggcuacugccagaggugcaaggcggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccuga

SEQ ID NO: 1845 - RNA, 2037 nt, Artificial Sequence
  derived and/or modified CDS sequence (opt3) from DENV-3 Consensus__SSopt-prME(H149N)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagaaccagguuggcaaugagacccaaggggugacugcagaaauuacgccucaggcuuccacaaccgaggccauccucccagaauauggaacucuuggccuggagugcucuccgagaaccgguuuggacuucaacgagaugauccuacugacaaugaagaauaaagcguggaugguccacaggcagugguuuuucgaucucccccugccuuggaccagcggggccacuacagaaacgccaaccuggaaccggaaggagcuucuggugacuuuuaagaaugcacaugcuaaaaagcaagaaguaguuguguugggcucccaggagggagccaugcacacagcucucaccggcgccacagaaauucagaacucagggggaaccaguauauucgcaggucaccugaaaugucguuuaaagauggacaaacuggagcuaaagggcaugagcuacgccaugugcacuaacacguuuguccucaagaaagaggugucugaaacccagcaugggacaauccugauuaaggucgaguacaaaggagaagaugugcccuguaagaucccuuucuccacugaggacggccaagguaaagcucacaaugggcgccuuauaaccgcgaacccaguugugacaaagaaggaggaacccguaaauauugaggcagaaccgccuuucggcgagucaaacaucgucaucggaauuggcgauaaugccuugaaaaucaacugguauaagaaagggagcaguauuggaaagauguuugaagcuacugccagaggugcaaggcggauggccauacugggcgacaccgcuugggauuucgggucugugggaggcguucucaauucccuggguaaaauggugcaucagaucuuugggagcgccuacacggcacuuuucucgggcgucucuugggugaugaagauuggaaucggcguacuguugacauggaucgggcucaacuccaagaauaccucaaugaguuuuagcugcauugcgauaggaaucauuacucuguauuuaggcgcugugguucaggccuga

SEQ ID NO: 1846 - RNA, 2037 nt, Artificial Sequence
  derived and/or modified CDS sequence (opt3) from DENV-3 Consensus__SSopt-prME(S184F)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcuucccgagaaccgguuuggacuuuaaugagaugauccuacugacaaugaagaacaaagcguggaugguccauaggcagugguucuuugaucucccccugccuuggaccucuggggccacuacagaaacgccaaccuggaaucggaaggagcuucuggugacuuucaagaacgcacacgcuaaaaagcaagaaguaguuguguugggcagccaggagggagccaugcacacagcucucaccggcgccacagaaauucaaaauuccgggggaacuucaauauuugcaggucaucugaaaugucguuuaaagauggacaaacuggagcuaaagggcaugaguuacgccaugugcaccaacacguucguccucaagaaagaggugagcgaaacccagcacgggacaauccugauuaaggucgaguacaaaggagaagaugugcccuguaagaucccuuucucuacugaggacggccaggguaaagcucauaacgggcgccuuauaaccgcgaauccaguugugacaaagaaggaggaacccguaaacauugaggcagaaccgccuuuuggcgaguccaauaucgucaucggaauuggcgauaacgccuugaaaaucaauugguauaagaaagggucaagcauuggaaagauguucgaagcuacugccagaggugcaaggcggauggccauacugggcgacaccgcuugggauuuugggagugugggaggcguucucaacucucuggguaaaauggugcaccagaucuucggguccgccuacacggcacuuuuuagcggcgucucgugggugaugaagauuggaaucggcguacuguugacauggaucgggcucaauucuaagaacaccuccaugucauucaguugcauugcgauaggaaucauuacucuguauuuaggcgcugugguucaggccuga

SEQ ID NO: 1847 - RNA, 2037 nt, Artificial Sequence
  derived and/or modified CDS sequence (opt3) from DENV-3 Consensus__SSopt-prME(R186L)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccguugaccggucuagacuucaaugagaugauccugcucacaaugaagaacaaagcguggaugguccauagacagugguuuuucgaucugccccuuccuuggaccagcggggccacuacagaaacgccaaccuggaauaggaaggagcuguuggugacuuuuaagaacgcacacgcuaaaaagcaagaaguaguugugcucggcucccaggagggagccaugcacacagcucugaccggcgccacagaaauucagaauagugggggaacuucaauauucgcaggucauuuaaaaugucggcugaagauggacaaacuagagcucaagggcaugagcuacgccaugugcaccaacacguuuguccugaagaaagaggugucugaaacccagcacgggacaauccuuauuaaggucgaguacaaaggagaagaugugcccuguaagaucccuuucuccacugaggacggccaagguaaagcucauaacgggcguuugauaaccgcgaauccaguugugacaaagaaggaggaacccguaaacauugaggcagaaccgccuuucggcgagucaaauaucgucaucggaauuggcgauaacgcccugaaaaucaauugguauaagaaagggagcaguauuggaaagauguuugaagcuacugcccgcggugcaagaaggauggccauacucggcgacaccgcuugggauuucgggucugugggaggcguucugaacucccuugguaaaauggugcaccagaucuuugggagcgccuacacggcacuguucucgggcgucucuugggugaugaagauuggaaucggcguauugcucacauggaucggguuaaauuccaagaacaccucaaugaguuuuagcugcauugcgauaggaaucauuacucuguaucugggcgcugugguucaggccuga

SEQ ID NO: 1848 - RNA, 2037 nt, Artificial Sequence
  derived and/or modified CDS sequence (opt3) from DENV-3 Consensus__SSopt-prME(N240S)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgagaaccgguuuggacuucaaugagaugauccuacugacaaugaagaacaaagcguggaugguccauaggcagugguuuuucgaucucccccugccuuggaccagcggggccacuacagaaacgccaaccuggaaucggaaggagcuucuggugacuuuuaaguccgcacacgcuaaaaagcaagaaguaguuguguugggcucacaggagggagccaugcacacagcucucaccggcgccacagaaauucagaacagugggggaacuagcauauucgcaggucaucugaaaugucguuuaaagauggacaaacuggagcuaaagggcaugucuuacgccaugugcaccaauacguuuguccucaagaaagagguguccgaaacccagcacgggacaauccugauuaaggucgaguacaaaggagaagaugugcccuguaagaucccuuucucaacugaggacggccaagguaaagcucauaacgggcgccuuauaaccgcgaacccaguugugacaaagaaggaggaacccguaaauauugaggcagaaccgccuuucggcgagagcaacaucgucaucggaauuggcgauaaugccuugaaaaucaacugguauaagaaagggaguucuauuggaaagauguuugaagcuacugccagaggugcaaggcggauggccauacugggcgacaccgcuugggauuucggguccgugggaggcguucucaauagccuggguaaaauggugcaccagaucuuugggucggccuacacggcacuuuucucuggcgucuccugggugaugaagauuggaaucggcguacuguugacauggaucgggcucaacucaaagaauaccaguaugagcuuuuccugcauugcgauaggaaucauuacucuguauuuaggcgcugugguucaggccuga

SEQ ID NO: 1849 - RNA, 2037 nt, Artificial Sequence
  derived and/or modified CDS sequence (opt3) from DENV-3 Consensus__SSopt-prME(M258L)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgagaaccgguuuggacuucaaugagaugauccuacugacaaugaagaacaaagcguggaugguccauaggcagugguuuuucgaucucccccugccuuggaccagcggggccacuacagaaacgccaaccuggaaucggaaggagcuucuggugacuuuuaagaacgcacacgcuaaaaagcaagaaguaguuguguugggcucccaggagggagcccuccacacagcucugaccggcgccacagaaauucagaauagugggggaacuucaauauucgcaggucauuuaaaaugucgucugaagauggacaaacuagagcucaagggcaugagcuacgccaugugcaccaacacguuuguccugaagaaagaggugucugaaacccagcacgggacaauccuuauuaaggucgaguacaaaggagaagaugugcccuguaagaucccuuucuccacugaggacggccaagguaaagcucauaacgggcgcuugauaaccgcgaauccaguugugacaaagaaggaggaacccguaaacauugaggcagaaccgccuuucggcgagucaaauaucgucaucggaauuggcgauaacgcccugaaaaucaauugguauaagaaagggagcaguauuggaaagauguuugaagcuacugccagaggugcaaggcggauggccauacucggcgacaccgcuugggauuucgggucugugggaggcguucugaacucccuugguaaaauggugcaccagaucuuugggagcgccuacacggcacuguucucgggcgucucuugggugaugaagauuggaaucggcguauugcucacauggaucggguuaaauuccaagaacaccucaaugaguuuuagcugcauugcgauaggaaucauuacucuguaucugggcgcugugguucaggccuga

SEQ ID NO: 1850 - RNA, 2037 nt, Artificial Sequence
  derived and/or modified CDS sequence (opt3) from DENV-3 Consensus__SSopt-prME(H259N)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgagaaccgguuuggacuucaaugagaugauccuacugacaaugaagaacaaagcguggaugguccauaggcagugguuuuucgaucucccccugccuuggaccagcggggccacuacagaaacgccaaccuggaaucggaaggagcuucuggugacuuuuaagaacgcacacgcuaaaaagcaagaaguaguuguguugggcucccaggagggagccaugaauacagcucucaccggcgccacagaaauucagaacucagggggaaccaguauauucgcaggucaccugaaaugucguuuaaagauggacaaacuggagcuaaagggcaugagcuacgccaugugcacuaacacguuuguccucaagaaagaggugucugaaacccagcaugggacaauccugauuaaggucgaguacaaaggagaagaugugcccuguaagaucccuuucuccacugaggacggccaagguaaagcucacaaugggcgccuuauaaccgcgaacccaguugugacaaagaaggaggaacccguaaauauugaggcagaaccgccuuucggcgagucaaacaucgucaucggaauuggcgauaaugccuugaaaaucaacugguauaagaaagggagcaguauuggaaagauguuugaagcuacugccagaggugcaaggcggauggccauacugggcgacaccgcuugggauuucgggucugugggaggcguucucaauucccuggguaaaauggugcaucagaucuuugggagcgccuacacggcacuuuucucgggcgucucuugggugaugaagauuggaaucggcguacuguugacauggaucgggcucaacuccaagaauaccucaaugaguuuuagcugcauugcgauaggaaucauuacucuguauuuaggcgcugugguucaggccuga

SEQ ID NO: 1851 - RNA, 2037 nt, Artificial Sequence
  derived and/or modified CDS sequence (opt3) from DENV-3 Consensus__SSopt-prME(H259R)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgagaaccgguuuggacuucaaugagaugauccuacugacaaugaagaacaaagcguggaugguccauaggcagugguuuuucgaucucccccugccuuggaccagcggggccacuacagaaacgccaaccuggaaucggaaggagcuucuggugacuuuuaagaacgcacacgcuaaaaagcaagaaguaguuguguugggcucccaggagggagccaugcguacagcucucaccggcgccacagaaauucagaauagugggggaacuucaauauucgcaggucaccugaaaugucgcuuaaagauggacaaacuggagcuaaagggcaugagcuacgccaugugcaccaacacguuuguccucaagaaagaggugucugaaacccagcaugggacaauccugauuaaggucgaguacaaaggagaagaugugcccuguaagaucccuuucuccacugaggacggccaagguaaagcucacaacgggagacuuauaaccgcgaauccaguugugacaaagaaggaggaacccguaaacauugaggcagaaccgccuuucggcgagucaaauaucgucaucggaauuggcgauaacgccuugaaaaucaauugguauaagaaagggagcaguauuggaaagauguuugaagcuacugccaggggugcacggcgaauggccauacugggcgacaccgcuugggauuucgggucugugggaggcguucucaacucccuggguaaaauggugcaucagaucuuugggagcgccuacacggcacuuuucucgggcgucucuugggugaugaagauuggaaucggcguacuguugacauggaucgggcucaauuccaagaacaccucaaugaguuuuagcugcauugcgauaggaaucauuacucuguauuuaggcgcugugguucaggccuga

SEQ ID NO: 1852 - RNA, 2037 nt, Artificial Sequence
  derived and/or modified CDS sequence (opt3) from DENV-3 Consensus__SSopt-prME(A265T)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgagaaccgguuuggacuucaaugagaugauccuacugacaaugaagaacaaagcguggaugguccauaggcagugguuuuucgaucucccccugccuuggaccagcggggccacuacagaaacgccaaccuggaaucggaaggagcuucuggugacuuuuaagaacgcacacgcuaaaaagcaagaaguaguuguguugggcucccaggagggagccaugcacacagcucucaccggcacaacugaaauucaaaauucagggggaaccaguauauucgccggucaucugaaaugucguuuaaagauggacaaacuggagcuaaagggcaugagcuacgcaaugugcacgaacaccuuuguccucaagaaagaggugucugaaacacagcacgggacuauccugauuaaggucgaguacaaaggagaagaugugcccuguaagaucccuuucuccaccgaggacggccaggguaaagcccauaacgggcgccuuauaacagcuaauccaguugugacuaagaaggaggaacccguaaacauugaggcggaaccgccuuucggcgagucaaauaucgucaucggaauuggcgauaacgcauugaaaaucaauugguauaagaaagggagcaguauuggaaagauguuugaagccaccgcuagaggugccaggcggauggcaauacugggcgacacggccugggauuucgggucugugggaggcguucucaacucccuggguaaaauggugcaccagaucuuugggagcgcuuacacagcccuuuucucgggcgucucuugggugaugaagauuggaaucggcguacuguugaccuggaucgggcucaauuccaagaacacuucaaugaguuuuagcugcauugcaauaggaaucauuacacuguauuuaggcgcggugguucaggcuuga

SEQ ID NO: 1853 - RNA, 2037 nt, Artificial Sequence
  derived and/or modified CDS sequence (opt3) from DENV-3 Consensus__SSopt-prME(S296G)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgagaaccgguuuggacuucaaugagaugauccuacugacaaugaagaacaaagcguggaugguccauaggcagugguuuuucgaucucccccugccuuggaccagcggggccacuacagaaacgccaaccuggaaucggaaggagcuucuggugacuuuuaagaacgcacacgcuaaaaagcaagaaguaguuguguugggcucccaggagggagccaugcacacagcucucaccggcgccacagaaauucagaauagugggggaacuucaauauucgcaggucaucugaaaugucguuuaaagauggacaaacuggagcuaaagggcaugggguacgccaugugcaccaacacguuuguccucaagaaagaggugagcgaaacccagcacggaacaauccugauuaaggucgaguacaaaggcgaagaugugcccuguaagaucccuuucucuacugaggacggucaagggaaagcucauaacggccgccuuauaaccgcgaauccaguugugacaaagaaggaggaacccguaaacauugaggcagaaccgccuuucggagaguccaauaucgucaucggcauuggggauaacgccuugaaaaucaauugguauaagaaaggaucaagcauugguaagauguuugaagcuacugccagaggcgcaaggcggauggccauacugggggacaccgcuugggauuucggaagugugggcgguguucucaacucucuggggaaaauggugcaccagaucuuuggcuccgccuacacggcacuuuucagcggagucucgugggugaugaagauuggcaucgggguacuguugacauggaucggacucaauucuaagaacaccuccaugucauuuaguugcauugcgauaggcaucauuacucuguauuuaggugcugugguucaggccuga

SEQ ID NO: 1854 - RNA, 2037 nt, Artificial Sequence
  derived and/or modified CDS sequence (opt3) from DENV-3 Consensus__SSopt-prME(S311R)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgagaaccgguuuggacuucaaugagaugauccuacugacaaugaagaacaaagcguggaugguccauaggcagugguuuuucgaucucccccugccuuggaccagcggggccacuacagaaacgccaaccuggaaucggaaggagcuucuggugacuuuuaagaacgcacacgcuaaaaagcaagaaguaguuguguugggcucccaggagggagccaugcacacagcucucaccggcgccacagaaauucagaauagugggggaacuucaauauucgcaggucaucugaaaugucguuuaaagauggacaaacuggagcuaaagggcaugagcuacgccaugugcaccaacacguuuguccucaagaaagaggugcgcgaaacccagcacgggacaauccugauuaaggucgaguacaaaggagaagaugugcccuguaagaucccuuucucuacugaggacggccaagguaaagcucauaacgggagacuuauaaccgcgaauccaguugugacaaagaaggaggaacccguaaacauugaggcagaaccgccuuucggcgaguccaauaucgucaucggaauuggcgauaacgccuugaaaaucaauugguauaagaaagggucaagcauuggaaagauguuugaagcuacugccaggggugcacggcgaauggccauacugggcgacaccgcuugggauuucgggagugugggaggcguucucaacucucuggguaaaauggugcaccagaucuuuggguccgccuacacggcacuuuucagcggcgucucgugggugaugaagauuggaaucggcguacuguugacauggaucgggcucaauucuaagaacaccuccaugucauuuaguugcauugcgauaggaaucauuacucuguauuuaggcgcugugguucaggccuga

SEQ ID NO: 1855 - RNA, 2037 nt, Artificial Sequence
  derived and/or modified CDS sequence (opt3) from DENV-3 Consensus__SSopt-prME(K321T)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgagaaccgguuuggacuucaaugagaugauccuacugacaaugaagaacaaagcguggaugguccauaggcagugguuuuucgaucucccccugccuuggaccagcggggccacuacagaaacgccaaccuggaaucggaaggagcuucuggugacuuuuaagaacgcacacgcuaaaaagcaagaaguaguuguguugggcucccaggagggagccaugcacacagcucucaccggcgccacagaaauucagaauagugggggaacuucaauauucgcaggucaucugaaaugucguuuaaagauggacaaacuggagcuaaagggcaugagcuacgccaugugcaccaacacguuuguccucaagaaagaggugucugaaacccagcacgggacaauccugauuacugucgaguacaagggagaagaugugcccuguaaaaucccuuucuccaccgaggacggccaagguaaggcucauaacgggcgccuuauaacagcgaauccaguugugacuaaaaaggaggaacccguaaacauugaggcagaaccgccuuucggcgagucaaauaucgucaucggaauuggcgauaacgccuugaagaucaauugguauaaaaaggggagcaguauuggaaaaauguuugaagcuaccgccagaggugcaaggcggauggccauacugggcgacacggcuugggauuucgggucugugggaggcguucucaacucccuggguaagauggugcaccagaucuuugggagcgccuacacagcacuuuucucgggcgucucuugggugaugaaaauuggaaucggcguacuguugaccuggaucgggcucaauuccaagaacacuucaaugaguuuuagcugcauugcgauaggaaucauuacacuguauuuaggcgcugugguucaggccuga

SEQ ID NO: 1856 - RNA, 2037 nt, Artificial Sequence
  derived and/or modified CDS sequence (opt3) from DENV-3 Consensus__SSopt-prME(G28C,H242C)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacugcggcugugugacgacuauggcgaaaaauaagcccacacuagacauugagcuccagaaaaccgaagcaacucaacuggccacacuucggaagcugugcaucgaggggaagauuaccaacaucacgaccgauagccgcuguccuacacagggagaagcuacuuugccagaggaacaggaccagaauuaugucugcaaacacaccuacguugaucgaggcugggguaacgggugcggacucuucggcaagggcagucuggugacaugugccaaauuucaaugcuuagagcccauagaggggaagguagugcaguaugaaaaucugaaauacacugucauuaucaccgugcauacaggagaccagcaccagguugguaacgagacccaaggcgugacugcagaaauuacgccucaggcuuccacaaccgaggccauccucccagaauaugggacucuuggacuggaguguucuccgagaaccggcuuggacuucaaugagaugauccuacugacaaugaagaacaaagcguggaugguccauaggcagugguuuuucgaucucccccugccuuggaccagcggugccacuacagaaacgccaaccuggaaucggaaggagcuucuggugacuuuuaagaacgcaugcgcuaaaaagcaagaaguaguuguguuggggucccaggagggcgccaugcacacagcucucaccggagccacagaaauucagaauaguggcgggacuucaauauucgcaggacaccugaaaugucguuuaaagauggacaaacuggagcuaaaggguaugagcuacgccaugugcaccaacacguuuguccucaagaaagaggugucugaaacccagcauggcacaauccugauuaaggucgaguacaaaggggaagaugugcccuguaagaucccuuucuccacugaggacggacaaggcaaagcucacaacggucgccuuauaaccgcgaauccaguugugacaaagaaggaggaacccguaaacauugaggcagaaccgccuuucggggagucaaauaucgucaucggcauuggagauaacgccuugaaaaucaauugguauaagaaaggcagcaguauugggaagauguuugaagcuacugccagaggagcaaggcggauggccauacugggugacaccgcuugggauuucggcucuguugggggagugcucaacucccugggcaaaauggugcaucagaucuuugguagcgccuacacggcacuuuucucgggggucucuugggugaugaagauuggcaucggaguacuguugacauggaucggccucaauuccaagaacaccucaaugaguuuuagcugcauugcgauagggaucauuacucuguauuuaggagcugugguucaggccuga

SEQ ID NO: 1857 - RNA, 2037 nt, Artificial Sequence
  derived and/or modified CDS sequence (opt3) from DENV-3 Consensus__SSopt-prME(R186L,A265T)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccguugaccggucuagacuucaaugagaugauccugcucacaaugaagaacaaagcguggaugguccauagacagugguuuuucgaucugccccuuccuuggaccagcggggccacuacagaaacgccaaccuggaauaggaaggagcuguuggugacuuuuaagaacgcacacgcuaaaaagcaagaaguaguugugcucggcucccaggagggagccaugcacacagcucugaccggcacaacugaaauucaaaauucagggggaaccaguauauucgccggucauuuaaaaugucggcugaagauggacaaacuagagcucaagggcaugagcuacgcaaugugcacgaacaccuuuguccugaagaaagaggugucugaaacacagcacgggacuauccuuauuaaggucgaguacaaaggagaagaugugcccuguaagaucccuuucuccaccgaggacggccaggguaaagcccauaacgggcguuugauaacagcuaauccaguugugacuaagaaggaggaacccguaaacauugaggcggaaccgccuuucggcgagucaaauaucgucaucggaauuggcgauaacgcacugaaaaucaauugguauaagaaagggagcaguauuggaaagauguuugaagccaccgcucgcggugccagaaggauggcaauacucggcgacacggccugggauuucgggucugugggaggcguucugaacucccuugguaaaauggugcaccagaucuuugggagcgcuuacacagcccuguucucgggcgucucuugggugaugaagauuggaaucggcguauugcucaccuggaucggguuaaauuccaagaacacuucaaugaguuuuagcugcauugcaauaggaaucauuacacuguaucugggcgcggugguucaggcuuga

SEQ ID NO: 1858 - RNA, 2037 nt, Artificial Sequence
  derived and/or modified CDS sequence (opt3) from DENV-3 Consensus__SSopt-pr(D104A)ME(F108S)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugccaagagaagcguagcacuugcaccccaugugggcaugggucuggacacaaggacccaaacguggauguccgcugagggggcauggcggcaggucgaaaaaguggagacuugggccuugcgccacccuggauucaccauucucgcucuguuucuggcccauuacaucggcacaucucucacucagaagguugugauauucaucuuacugaugcuugucaccccaucgaugacaaugagaugugugggcguagggaacagggauuuuguugaaggauugucaggugcgaccuggguggacgucgugcuggagcacggcgggugcgugacgacuauggccaaaaauaagcccacacuagauauugagcuccagaaaaccgaagccacucaacuggcuacacuucggaagcuguguaucgagggaaagauuaccaacaucacgaccgacagccgcugcccuacacagggcgaagccacuuugccagaggaacaggaucagaauuaugucuguaaacacaccuacguugaccgagguugggggaacggaugcggccucaguggcaaggggucccuggugacaugcgcaaaauuccaauguuuagagcccauagagggaaagguagugcaguaugaaaaucugaaauacacugucauuaucaccgugcauacaggugaucagcaccagguuggcaacgagacccaaggggugacugcugaaauuacgccucaggccucuacaaccgaggcgauccucccagaauauggaacucuuggccuggagugcagcccgagaaccgguuuggacuuuaaugagaugauccuacugacaaugaagaacaaagccuggaugguccauaggcagugguucuuugaccucccccugccuuggaccuccggggcaacuacagaaacgccaaccuggaaucggaaggagcuucuggugacuuucaagaacgcucacgccaaaaagcaagaaguaguuguguugggcucacaggagggagcuaugcacacagcccucaccggcgcaacagaaauucagaauagugggggaacuagcauauuugccggucaucugaaaugucguuuaaagauggauaaacuggagcuaaagggcaugucuuacgcuaugugcaccaacacguucguccucaagaaagagguguccgaaacccagcacgggacaauccugauuaaggucgaguacaaaggagaagacgugcccuguaagaucccuuuuucaacugaggauggccaagguaaagcgcauaacgggcgccuuauaaccgcaaauccaguugugacaaagaaggaggaacccguaaacauugaggccgaaccgccuuucggcgagagcaauaucgucaucggaauuggcgacaacgcuuugaaaaucaauugguauaagaaagggaguucuauuggaaagauguucgaagccacugcaagaggugccaggcggauggcuauacugggcgauaccgccugggacuuuggguccgugggaggcguucucaacagccuggguaaaauggugcaccagaucuucgggucggcauacacggcgcuguuuucuggcgucuccugggugaugaagauuggaaucggcguacuuuugacauggaucgggcucaauucaaagaacaccaguaugagcuucuccugcauugcuauaggaaucauuacucuguauuuaggcgccgugguucaggcauga

SEQ ID NO: 1859 - RNA, 2037 nt, Artificial Sequence
  derived and/or modified CDS sequence (opt3) from DENV-3 Consensus__SSopt-pr(D104A)ME(R186L,A265T)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugccaagagaagcguagcacuugcaccccaugugggcaugggucuggacacaaggacccaaacguggauguccgcugagggggcauggcggcaggucgaaaaaguggagacuugggccuugcgccacccuggauucaccauucucgcucuguuucuggcccauuacaucggcacaucucucacucagaagguugugauauucaucuuacugaugcuugucaccccaucgaugacaaugagaugugugggcguagggaacagggauuuuguugaaggauugucaggugcgaccuggguggacgucgugcuggagcacggcgggugcgugacgacuauggccaaaaauaagcccacacuagauauugagcuccagaaaaccgaagccacucaacuggcuacacuucggaagcuguguaucgagggaaagauuaccaacaucacgaccgacagccgcugcccuacacagggcgaagccacuuugccagaggaacaggaucagaauuaugucuguaaacacaccuacguugaccgagguugggggaacggaugcggccucuucggcaaggggagucuggugacaugcgcaaaauuucaauguuuagagcccauagagggaaagguagugcaguaugaaaaucugaaauacacugucauuaucaccgugcauacaggugaucagcaccagguuggcaacgagacccaaggggugacugcugaaauuacgccucaggccuccacaaccgaggcgauccucccagaauauggaacucuuggccuggagugcucuccguugaccggucuagacuucaaugagaugauccugcucacaaugaagaacaaagccuggaugguccauagacagugguuuuucgaccugccccuuccuuggaccagcggggcaacuacagaaacgccaaccuggaauaggaaggagcuguuggugacuuuuaagaacgcucacgccaaaaagcaagaaguaguugugcucggcucccaggagggagcuaugcacacagcccugaccggcacaacugaaauucaaaauucagggggaaccaguauauucgcaggucauuuaaaaugucggcugaagauggauaaacuagagcucaagggcaugagcuacgccaugugcacgaacaccuuuguccugaagaaagaggugucugaaacacagcacgggacuauccuuauuaaggucgaguacaaaggagaagacgugcccuguaagaucccuuucuccaccgaggauggccaggguaaagcucauaacgggcguuugauaacagcgaauccaguugugacuaagaaggaggaacccguaaacauugaggcagaaccgccuuucggcgagucaaauaucgucaucggaauuggcgacaacgcccugaaaaucaauugguauaagaaagggagcaguauuggaaagauguuugaagcuaccgcccgcggugcaagaaggauggccauacucggcgauacggcuugggacuucgggucugugggaggcguucugaacucccuugguaaaauggugcaccagaucuuugggagcgccuacacagcacuguucucgggcgucucuugggugaugaagauuggaaucggcguauugcucaccuggaucggguuaaauuccaagaacacuucaaugaguuuuagcugcauugcgauaggaaucauuacacuguaucugggcgcugugguucaggccuga

SEQ ID NO: 1860 - RNA, 2037 nt, Artificial Sequence
  derived and/or modified CDS sequence (opt3) from DENV-3 Consensus__SSopt-pr(D104A)ME(F108S,R186L,A265T)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugccaagagaagcguagcacuugcaccccaugugggcaugggucuggacacaaggacccaaacguggauguccgcugagggggcauggcggcaggucgaaaaaguggagacuugggccuugcgccacccuggauucaccauucucgcucuguuucuggcccauuacaucggcacaucucucacucagaagguugugauauucaucuuacugaugcuugucaccccaucgaugacaaugagaugugugggcguagggaacagggauuuuguugaaggauugucaggugcgaccuggguggacgucgugcuggagcacggcgggugcgugacgacuauggccaaaaauaagcccacacuagauauugagcuccagaaaaccgaagccacucaacuggcuacacuucggaagcuguguaucgagggaaagauuaccaacaucacgaccgacagccgcugcccuacacagggcgaagccacuuugccagaggaacaggaucagaauuaugucuguaaacacaccuacguugaccgagguugggggaacggaugcggccucaguggcaaggggucccuggugacaugcgcaaaauuccaauguuuagagcccauagagggaaagguagugcaguaugaaaaucugaaauacacugucauuaucaccgugcauacaggugaucagcaccagguuggcaacgagacccaaggggugacugcugaaauuacgccucaggccucuacaaccgaggcgauccucccagaauauggaacucuuggccuggagugcagcccguugaccggucuagacuuuaaugagaugauccugcucacaaugaagaacaaagccuggaugguccauagacagugguucuuugaccugccccuuccuuggaccuccggggcaacuacagaaacgccaaccuggaauaggaaggagcuguuggugacuuucaagaacgcucacgccaaaaagcaagaaguaguugugcucggcucacaggagggagcuaugcacacagcccugaccggcacaacugaaauucagaauagugggggaaccagcauauuugcaggucauuuaaaaugucggcugaagauggauaaacuagagcucaagggcaugucuuacgccaugugcacgaacaccuucguccugaagaaagagguguccgaaacacagcacgggacuauccuuauuaaggucgaguacaaaggagaagacgugcccuguaagaucccuuuuucaaccgaggauggccaagguaaagcucauaacgggcguuugauaacagcgaauccaguugugacuaagaaggaggaacccguaaacauugaggcagaaccgccuuucggcgagagcaauaucgucaucggaauuggcgacaacgcccugaaaaucaauugguauaagaaagggaguucuauuggaaagauguucgaagcuaccgcccgcggugcaagaaggauggccauacucggcgauacggcuugggacuuuggguccgugggaggcguucugaacagccuugguaaaauggugcaccagaucuucgggucggccuacacagcacuguuuucuggcgucuccugggugaugaagauuggaaucggcguauugcucaccuggaucgggcugaauaguaagaacacuucaaugagcuucuccugcauugcgauaggaaucauuacauuauaucugggcgcugugguucaggccuga

SEQ ID NO: 1861 - RNA, 2016 nt, Artificial Sequence
  derived and/or modified CDS sequence (opt3) from DENV-3 Consensus__SSopt-prMEdel101-107,(R99P,F108N)
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucccgguaacgggaagggaagucucgugacaugcgccaaauuccaaugccuggagccuauagagggcaagguagugcaguaugaaaauuuaaaauacacugucauuaucaccgugcauacaggcgaccagcaccagguugggaacgagacccaaggagugacugcagaaauuacgccacaggcuuccacaaccgaggccauccugccggaauaugguacucucggccuugaguguucuccccgaaccgggcuggacuuuaaugagaugaucuugcuaacaaugaagaacaaagcguggaugguccauagacagugguucuuugaucugccucucccauggaccagcggagccacuacagaaacgcccaccuggaauaggaaggagcugcuugugacuuucaagaacgcacacgcuaaaaagcaagaaguaguugugcugggcucccaggagggugccaugcacacagcuuugaccggggccacagaaauucagaauaguggcggaacuucaauauuugcaggccaucucaaaugccggcugaagauggacaaauuagagcugaaggggaugagcuacgccauguguaccaacacguucguccuaaagaaagaggugucugaaacccagcacggaacaauccucauuaaggucgaguacaaaggugaagaugugccuugcaagaucccauuuuccacugaggacggccaagggaaagcucauaacggacgucugauaaccgcgaaucccguugugacaaagaaggaggaaccgguaaacauugaggcagaaccucccuucggcgagucaaauaucgucaucgguauuggggauaacgcccuuaaaaucaauugguauaagaaaggcagcaguauuggaaagauguucgaagcuacugcccgcggcgcaagaaggauggccauauugggggacaccgcuugggauuuuggaucuguggguggcguucugaacucccucgggaaaauggugcaccagaucuucggaagcgccuacacggcacuguuuucgggcgucucuugggugaugaagauugguaucgggguacuucugacauggaucggccucaauuccaagaacaccucaaugaguuucagcuguauugcgauaggaaucauuacuuuguaucugggcgcugugguucaggccuga

SEQ ID NO: 1862 - RNA, 2037 nt, Artificial Sequence
  derived and/or modified CDS sequence (opt3) from DENV-3 Consensus__SSopt-prMEdelstem_TM-JEV
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgagaaccgguuuggacuucaaugagaugauccuacugacaaugaagaacaaagcguggaugguccauaggcagugguuuuucgaucucccccugccuuggaccagcggggccacuacagaaacgccaaccuggaaucggaaggagcuucuggugacuuuuaagaacgcacacgcuaaaaagcaagaaguaguuguguugggcucccaggagggagccaugcacacagcucucaccggcgccacagaaauucagaauagugggggaacuucaauauucgcaggucaucugaaaugucguuuaaagauggacaaacuggagcuaaagggcaugagcuacgccaugugcaccaacacguuuguccucaagaaagaggugucugaaacccagcacgggacaauccugauuaaggucgaguacaaaggagaagaugugcccuguaagaucccuuucuccacugaggacggccaagguaaagcucauaacgggcgccuuauaaccgcgaauccaguugugacaaagaaggaggaacccguaaacauugaggcagaaccgccuuucggcgagucaaauaucgucaucggaauuggcgauaacgccuugaaaaucaauugguauaagaaagggagcacucugggaaaggcuuuuaguaccacgcucaaaggugcccagagacuggcagcccuuggcgacacagcuugggauuucgggucuauuggaggcguguuuaacuccauagguagggccguucaccagguguucgggggcgcauuucggacccuguucggaggcaugagcuggaucacucagggguugaugggagcgcuccuguuauggaugggcgucaaugcucgagaccgcucgauugcccuggcauuucuagccacagguggggugcucguauuccuggcuaccaacgugcaugccuga

SEQ ID NO: 1863 - RNA, 2037 nt, Artificial Sequence
  derived and/or modified CDS sequence (opt3) from DENV-3 Consensus__SSopt-pr(D104A)MEdelstem_TM,(F108S)-JEV
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugccaagagaagcguagcacuugcaccccaugugggcaugggucuggacacaaggacccaaacguggauguccgcugagggggcauggcggcaggucgaaaaaguggagacuugggccuugcgccacccuggauucaccauucucgcucuguuucuggcccauuacaucggcacaucucucacucagaagguugugauauucaucuuacugaugcuugucaccccaucgaugacaaugagaugugugggcguagggaacagggauuuuguugaaggauugucaggugcgaccuggguggacgucgugcuggagcacggcgggugcgugacgacuauggccaaaaauaagcccacacuagauauugagcuccagaaaaccgaagccacucaacuggcuacacuucggaagcuguguaucgagggaaagauuaccaacaucacgaccgacagccgcugcccuacacagggcgaagccacuuugccagaggaacaggaucagaauuaugucuguaaacacaccuacguugaccgagguugggggaacggaugcggccucaguggcaaggggucccuggugacaugcgcaaaauuccaauguuuagagcccauagagggaaagguagugcaguaugaaaaucugaaauacacugucauuaucaccgugcauacaggugaucagcaccagguuggcaacgagacccaaggggugacugcugaaauuacgccucaggccucuacaaccgaggcgauccucccagaauauggaacucuuggccuggagugcagcccgagaaccgguuuggacuuuaaugagaugauccuacugacaaugaagaacaaagccuggaugguccauaggcagugguucuuugaccucccccugccuuggaccuccggggcaacuacagaaacgccaaccuggaaucggaaggagcuucuggugacuuucaagaacgcucacgccaaaaagcaagaaguaguuguguugggcucacaggagggagcuaugcacacagcccucaccggcgcaacagaaauucagaauagugggggaacuagcauauuugccggucaucugaaaugucguuuaaagauggauaaacuggagcuaaagggcaugucuuacgcuaugugcaccaacacguucguccucaagaaagagguguccgaaacccagcacgggacaauccugauuaaggucgaguacaaaggagaagacgugcccuguaagaucccuuuuucaacugaggauggccaagguaaagcgcauaacgggcgccuuauaaccgcaaauccaguugugacaaagaaggaggaacccguaaacauugaggccgaaccgccuuucggcgagagcaauaucgucaucggaauuggcgacaacgcuuugaaaaucaauugguauaagaaagggaguacucugggaaaggccuucucuaccacgcucaaaggugcacagagacuggccgcucuuggcgauacagccugggacuuuggguccauuggaggcguguucaacagcauagguagggcaguucaccagguguuugggggcgcguuccggacccuguuuggaggcaugucguggaucacucagggguugaugggagcucuccuguuauggaugggcgucaaugcccgagaucgcucuauugcacuggccuuccuagcuacagguggggugcucguauuucuggccaccaacgugcaugcauga

SEQ ID NO: 1864 - RNA, 2037 nt, Artificial Sequence
  derived and/or modified CDS sequence (opt3) from DENV-3 Consensus__SSopt-pr(D104A)MEdelstem_TM,(R186L,A265T)-JEV
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugccaagagaagcguagcacuugcaccccaugugggcaugggucuggacacaaggacccaaacguggauguccgcugagggggcauggcggcaggucgaaaaaguggagacuugggccuugcgccacccuggauucaccauucucgcucuguuucuggcccauuacaucggcacaucucucacucagaagguugugauauucaucuuacugaugcuugucaccccaucgaugacaaugagaugugugggcguagggaacagggauuuuguugaaggauugucaggugcgaccuggguggacgucgugcuggagcacggcgggugcgugacgacuauggccaaaaauaagcccacacuagauauugagcuccagaaaaccgaagccacucaacuggcuacacuucggaagcuguguaucgagggaaagauuaccaacaucacgaccgacagccgcugcccuacacagggcgaagccacuuugccagaggaacaggaucagaauuaugucuguaaacacaccuacguugaccgagguugggggaacggaugcggccucuucggcaaggggagucuggugacaugcgcaaaauuucaauguuuagagcccauagagggaaagguagugcaguaugaaaaucugaaauacacugucauuaucaccgugcauacaggugaucagcaccagguuggcaacgagacccaaggggugacugcugaaauuacgccucaggccuccacaaccgaggcgauccucccagaauauggaacucuuggccuggagugcucuccguugaccggucuagacuucaaugagaugauccugcucacaaugaagaacaaagccuggaugguccauagacagugguuuuucgaccugccccuuccuuggaccagcggggcaacuacagaaacgccaaccuggaauaggaaggagcuguuggugacuuuuaagaacgcucacgccaaaaagcaagaaguaguugugcucggcucccaggagggagcuaugcacacagcccugaccggcacaacugaaauucaaaauucagggggaaccaguauauucgcaggucauuuaaaaugucggcugaagauggauaaacuagagcucaagggcaugagcuacgccaugugcacgaacaccuuuguccugaagaaagaggugucugaaacacagcacgggacuauccuuauuaaggucgaguacaaaggagaagacgugcccuguaagaucccuuucuccaccgaggauggccaggguaaagcucauaacgggcguuugauaacagcgaauccaguugugacuaagaaggaggaacccguaaacauugaggcagaaccgccuuucggcgagucaaauaucgucaucggaauuggcgacaacgcccugaaaaucaauugguauaagaaagggagcacccucggaaaggcuuuuaguacgacacugaaaggugcccagcgccuugcagcccugggcgauaccgcuugggacuucgggucuauuggaggcguguuuaacuccauagguagagccguucaccagguguucgggggcgcauuuaggacuuuguucggaggcaugagcuggaucacacaggggcucaugggagcgcuguuacuguggaugggcgucaaugcucgggaucgaucgauugcccuagcauuucucgccaccgguggggugcugguauuccuugcuacuaacgugcaugccuga

SEQ ID NO: 1865 - RNA, 2037 nt, Artificial Sequence
  derived and/or modified CDS sequence (opt3) from DENV-3 Consensus__SSopt-pr(D104A)MEdelstem_TM,(F108S,R186L,A265T)-JEV
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugccaagagaagcguagcacuugcaccccaugugggcaugggucuggacacaaggacccaaacguggauguccgcugagggggcauggcggcaggucgaaaaaguggagacuugggccuugcgccacccuggauucaccauucucgcucuguuucuggcccauuacaucggcacaucucucacucagaagguugugauauucaucuuacugaugcuugucaccccaucgaugacaaugagaugugugggcguagggaacagggauuuuguugaaggauugucaggugcgaccuggguggacgucgugcuggagcacggcgggugcgugacgacuauggccaaaaauaagcccacacuagauauugagcuccagaaaaccgaagccacucaacuggcuacacuucggaagcuguguaucgagggaaagauuaccaacaucacgaccgacagccgcugcccuacacagggcgaagccacuuugccagaggaacaggaucagaauuaugucuguaaacacaccuacguugaccgagguugggggaacggaugcggccucaguggcaaggggucccuggugacaugcgcaaaauuccaauguuuagagcccauagagggaaagguagugcaguaugaaaaucugaaauacacugucauuaucaccgugcauacaggugaucagcaccagguuggcaacgagacccaaggggugacugcugaaauuacgccucaggccucuacaaccgaggcgauccucccagaauauggaacucuuggccuggagugcagcccguugaccggucuagacuuuaaugagaugauccugcucacaaugaagaacaaagccuggaugguccauagacagugguucuuugaccugccccuuccuuggaccuccggggcaacuacagaaacgccaaccuggaauaggaaggagcuguuggugacuuucaagaacgcucacgccaaaaagcaagaaguaguugugcucggcucacaggagggagcuaugcacacagcccugaccggcacaacugaaauucagaauagugggggaaccagcauauuugcaggucauuuaaaaugucggcugaagauggauaaacuagagcucaagggcaugucuuacgccaugugcacgaacaccuucguccugaagaaagagguguccgaaacacagcacgggacuauccuuauuaaggucgaguacaaaggagaagacgugcccuguaagaucccuuuuucaaccgaggauggccaagguaaagcucauaacgggcguuugauaacagcgaauccaguugugacuaagaaggaggaacccguaaacauugaggcagaaccgccuuucggcgagagcaauaucgucaucggaauuggcgacaacgcccugaaaaucaauugguauaagaaagggaguacccucggaaaggcuuucucuacgacacugaaaggugcccagcgccuugcagcccugggcgauaccgcuugggacuuuggguccauuggaggcguguucaacagcauagguagagccguucaccagguguuugggggcgcauucaggacuuuguuuggaggcaugucguggaucacacaggggcucaugggagcgcuguuacuguggaugggcgucaaugcucgggaucgaucuauugcccuagcauuccucgccaccgguggggugcugguauuucuugcuacuaacgugcaugccuga

SEQ ID NO: 1866 - RNA, 2037 nt, Artificial Sequence
  derived and/or modified CDS sequence (opt3) from DENV-3 Consensus__SSopt-prMEdelstem_TM,(H259N)-JEV
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgagaaccgguuuggacuucaaugagaugauccuacugacaaugaagaacaaagcguggaugguccauaggcagugguuuuucgaucucccccugccuuggaccagcggggccacuacagaaacgccaaccuggaaucggaaggagcuucuggugacuuuuaagaacgcacacgcuaaaaagcaagaaguaguuguguugggcucccaggagggagccaugaauacagcucucaccggcgccacagaaauucagaacucagggggaaccaguauauucgcaggucaccugaaaugucguuuaaagauggacaaacuggagcuaaagggcaugagcuacgccaugugcacuaacacguuuguccucaagaaagaggugucugaaacccagcaugggacaauccugauuaaggucgaguacaaaggagaagaugugcccuguaagaucccuuucuccacugaggacggccaagguaaagcucacaaugggcgccuuauaaccgcgaacccaguugugacaaagaaggaggaacccguaaauauugaggcagaaccgccuuucggcgagucaaacaucgucaucggaauuggcgauaaugccuugaaaaucaacugguauaagaaagggagcacucugggaaaggcuuuuaguaccacgcucaaaggugcccagagacuggcagcccuuggcgacacagcuugggauuucgggucuauuggaggcguguuuaauuccauagguagggccguucaucagguguucgggggcgcauuucggacccuguucggaggcaugagcuggaucacucagggguugaugggagcgcuccuguuauggaugggcgucaacgcucgagaccgcucgauugcccuggcauuucuagccacagguggggugcucguauuccuggcuaccaaugugcacgccuga

SEQ ID NO: 1867 - RNA, 2037 nt, Artificial Sequence
  derived and/or modified CDS sequence (opt3) from DENV-3 Consensus__SSopt-prMEdelstem_TM,(R186L,A265T)-JEV
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucgagguugggggaacggaugcggccucuucggcaaggggagucuggugacaugcgccaaauuucaauguuuagagcccauagagggaaagguagugcaguaugaaaaucugaaauacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccguugaccggucuagacuucaaugagaugauccugcucacaaugaagaacaaagcguggaugguccauagacagugguuuuucgaucugccccuuccuuggaccagcggggccacuacagaaacgccaaccuggaauaggaaggagcuguuggugacuuuuaagaacgcacacgcuaaaaagcaagaaguaguugugcucggcucccaggagggagccaugcacacagcucugaccggcacaacugaaauucaaaauucagggggaaccaguauauucgccggucauuuaaaaugucggcugaagauggacaaacuagagcucaagggcaugagcuacgcaaugugcacgaacaccuuuguccugaagaaagaggugucugaaacacagcacgggacuauccuuauuaaggucgaguacaaaggagaagaugugcccuguaagaucccuuucuccaccgaggacggccaggguaaagcccauaacgggcguuugauaacagcuaauccaguugugacuaagaaggaggaacccguaaacauugaggcggaaccgccuuucggcgagucaaauaucgucaucggaauuggcgauaacgcacugaaaaucaauugguauaagaaagggagcacccucggaaaggccuuuaguacgacacugaaaggugcucagcgccuugccgcacugggcgacaccgccugggauuucgggucuauuggaggcguguuuaacuccauagguagagcuguucaccagguguucgggggcgccuuuaggacuuuguucggaggcaugagcuggaucacacaggggcucaugggagcacuguuacuguggaugggcgucaaugcgcgggaccgaucgauugcucuagccuuucucgcaaccgguggggugcugguauuccuugccacuaacgugcaugcuuga

SEQ ID NO: 1868 - RNA, 2016 nt, Artificial Sequence
  derived and/or modified CDS sequence (opt3) from DENV-3 Consensus__SSopt-prMEdelstem_TM,del101-107,(R99P,F108N)-JEV
augaagaggaaaaagaccagccugugccucaugaugauccuucccgccgcucuggcauuccacuugacauccagagacggcgagccucggaugauuguggggaaaaacgaacgcggaaagucuuuacuguuuaaaacugccucagguauaaauauguguacgcuaaucgcgauggaucucggcgagaugugcgacgauaccgucacauacaaguguccacauauuacugaaguugagccggaagacaucgauugcugguguaaccugaccaguacaugggugaccuaugggacuugcaaucaggcuggagagcaccgacgugacaagagaagcguagcccuugcaccccaugugggcaugggucuggauacaaggacccaaacguggauguccgccgagggggcuuggcggcaggucgaaaaaguggagacuugggcauugcgccacccuggauucaccauucucgcccuguuucuggcucauuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcacggcgggugcgugacgacuauggcgaaaaauaagcccacacuagacauugagcuccagaaaaccgaagcaacucaacuggccacacuucggaagcuguguaucgagggaaagauuaccaacaucacgaccgauagccgcugcccuacacagggcgaagcuacuuugccagaggaacaggaccagaauuaugucuguaaacacaccuacguugaucccgguaacgggaagggaagucucgugacaugcgccaaauuccaaugccuggagccuauagagggcaagguagugcaguaugaaaauuuaaaauacacugucauuaucaccgugcauacaggcgaccagcaccagguugggaacgagacccaaggagugacugcagaaauuacgccacaggcuuccacaaccgaggccauccugccggaauaugguacucucggccuugaguguucuccccgaaccgggcuggacuuuaaugagaugaucuugcuaacaaugaagaacaaagcguggaugguccauagacagugguucuuugaucugccucucccauggaccagcggagccacuacagaaacgcccaccuggaauaggaaggagcugcuugugacuuucaagaacgcacacgcuaaaaagcaagaaguaguugugcugggcucccaggagggugccaugcacacagcuuugaccggggccacagaaauucagaauaguggcggaacuucaauauuugcaggccaucucaaaugccggcugaagauggacaaauuagagcugaaggggaugagcuacgccauguguaccaacacguucguccuaaagaaagaggugucugaaacccagcacggaacaauccucauuaaggucgaguacaaaggugaagaugugccuugcaagaucccauuuuccacugaggacggccaagggaaagcucauaacggacgucugauaaccgcgaaucccguugugacaaagaaggaggaaccgguaaacauugaggcagaaccucccuucggcgagucaaauaucgucaucgguauuggggauaacgcccuuaaaaucaauugguauaagaaaggcagcacuuugggaaaggcuuucaguaccacgcugaaaggcgcccagcgccucgcagcccugggggacacagcuugggauuuuggaucuauugguggcguguucaacuccauagggagagccguucaccagguguuuggaggcgcauucaggacccuuuuuggugggaugagcuggaucacucagggccugaugggagcguugcuccuguggaugggcgucaaugcucgggaccgaucgauugccuuagcauuccuggccacagggggagugcuaguauuucucgcuaccaacgugcaugccuga

SEQ ID NO: 1869 - RNA, 3081 nt, Artificial Sequence
  derived and/or modified CDS sequence (opt3) from DENV-3 Consensus__SSc-prME-NS1
augaccagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcuacuuugccagaggaacaggaccagaauuaugucuguaaacacaccuacguugaucgcgguugggggaacggaugcggccucuucggcaaggggagucuggugacaugcgccaaguuucaauguuuagagcccauagagggaaaaguagugcaguaugaaaaucugaaguacacugucauuaucaccgugcauacaggugaccagcaccagguuggcaacgagacccaaggggugacugcagaaauuacgccucaggcuuccacaaccgaggccauccucccagaauauggaacucuuggccuggagugcucuccgcgaaccgguuuggacuucaaugagaugauccuacugacaaugaaaaacaaggcguggaugguccauagacagugguuuuucgaucucccccugccuuggaccagcggggccacuacagaaacgccaaccuggaauaggaaagagcuucuggugacuuuuaagaacgcacacgcuaaaaagcaagaaguaguuguguugggcucccaggagggagccaugcacacagcucucaccggcgccacagaaauucaaaauucagggggaacaaguauauucgcaggucaucugaagugucgguuaaaaauggacaagcuggagcuaaaaggcaugagcuacgccaugugcaccaacacguuuguccucaagaaagaggugucugaaacccagcacgggacaauccugauuaaggucgaguacaagggagaagaugugcccuguaaaaucccuuucuccacugaggacggccaggguaaggcucauaacgggcgucuuauaaccgcgaauccaguugugacuaaaaaggaggaacccguaaacauugaggcagaaccgccuuucggcgagucaaauaucgucaucggaauuggcgauaacgccuugaaaaucaauugguauaagaaggggagcaguauuggaaaaauguuugaagcuacugcccgcggugcaagaaggauggccauacugggcgacaccgcuugggauuucgggucugugggaggcguucucaacucccuggguaagauggugcaccagaucuuugggagcgccuacacggcacuuuucucgggcgucucuugggugaugaaaauuggaaucggcguacuguugacauggaucgggcucaauuccaagaacaccucaaugaguuuuagcugcauugcgauaggaaucauuacucuguauuuaggcgcugugguucaggccgacauggguugugucaucaauuggaaagggaaggagcugaagugcggauccggcauuuucgugacaaacgaggugcauaccuggacugaacaguacaaauuucaagcagauucucccaagcggcuagccaccgcuaucgccggugcaugggagaauggcgucugugggauacgaagcacaacgcgcauggaaaaccuccuguggaaacagaucgcuaaugagcuuaacuauauuuugugggaaaauaacaucaagcugaccguuguggugggagacauuaucggcguacucgagcaggggaaaagaacucugacaccacagccuauggaguuaaaguacucauggaaaaccuggggaaaggccaagauagucacagcggaaacucaaaacaguuccuucauuaucgauggccccaauaccccagagugccccagcgugucuagggccuggaacguuugggaaguggaggacuaugguuuuggggucuucacgacaaauauuuggcugaaacuucgggaaguguacacccaguugugugaccaccgccucaugucagcugcaguuaaggaugagagagccgugcacgcugacaugggauacuggaucgagagucagaaaaacggcagcuggaagcuggaaaaagccucccuaauagagguaaagacuugcaccuggccuaagucucauacacuguggucgaaugguguccucgaaagcgauaugaucauuccaaaaucccuggcaggcccgaucucacagcacaaccauaggcccggguaucacacucaaaccgcgggaccuuggcaccuuggcaaguuggagcuggacuuuaauuacugcgaggggacaacgguggugauuaccgaaaacuguggaacucguggcccaaguuuacggacaaccacugucucugguaaacucauccaugaguggugcugucgaagcugcacacugcccccucuuagauauaugggggaagauggauguugguacggcauggagauaaggccaauuuccgaaaaggaggagaauaugguuaaaucacuggugagcgccuga

SEQ ID NO: 1870 - RNA, 1824 nt, Artificial Sequence
  derived and/or modified CDS sequence (opt3) from DENV-3 Consensus__SSm-EdelTM-linker-ferritin
augacccagaagguggucaucuucauucugcucaugcuuguuacacccagcaugacuaugagaugcgugggcguagggaacagggacuuuguggagggacuguccggugccacgugggucgaugugguuuuggaacacggcgggugugugaccacaauggcuaaaaauaagccuacuuuagacauagagcugcagaaaaccgaagcaacacagcuagccacccuccggaagcugugcaucgagggaaaaauuacuaacaucacaaccgauucucgcuguccaacgcagggcgaagcgacucuuccggaggagcaggaccaaaauuacgucugcaagcauaccuauguggaucgagguugggggaacggauguggccuguucggcaaggggucauugguaacaugcgcuaaauuucagugucucgaacccauugagggaaagguugugcaguacgaaaaucugaaauauacugucaucauaaccgugcacacaggugaccagcaucaagugggcaacgagacccagggggucacggccgagaucacuccucaggcaaguacaaccgaagccauucugccagaguacggaacucucggcuuagaaugcagcccccguacaggucuggauuucaaugagaugauccuuuugaccaugaagaacaaggcuuggaugguucacagacagugguuuuucgaccugccucuaccauggacguccggggcaaccacagaaacucccaccuggaauaggaaagagcuccuggugacauuuaagaacgcccaugcuaaaaagcaagagguagugguccuuggaucucaggaaggcgccaugcacacugcgcugaccggcgcaacagagauucaaaauucagggggaaccucgaucuucgccggucacuugaaaugucggcucaagauggauaaacuggaauuaaagggcaugagcuaugcuaugugcacuaacacguuugugcugaaaaaggagguuagugaaacacaacaugggaccauacucauuaagguggaguacaaaggagaggacgucccuuguaagaucccauucuccacugaagauggccaggguaaagcccacaaugggcgccuuauuaccgcaaacccggugguaacaaagaaagaggaacccguuaauaucgaggcugaaccuccauuuggcgagucuaacaucgugauuggaauaggcgacaacgcccugaagaucaauugguauaagaaagggagcuccauuggaaagauguucgaggcgaccgccagaggugcaaggcggauggcuaucuugggcgauacugccugggacuuugggucaaguggaggcgacauaauuaaacuacugaacgaacaggucaauaaggagaugcagagcucuaaccucuacauguccaugucaagcuggugcuacacacauagucuggauggugcugggcuuuuccuguucgaccacgccgcagaagaguaugagcacgccaaaaaguugaucaucuuucucaaugaaaacaaugugcccguccaacugacgucuauuuccgcuccugagcauaaguucgaaggcuuaacccagaucuuucagaaagcguacgagcacgaacagcauauuagcgagucgauaaacaauaucguggaucacgcaauuaagucuaaagaccaugccacuuucaacuuucugcaaugguauguugcugagcagcacgaagaggaagugcuauucaaggauauccucgacaaaaucgagcugauuggaaaugaaaaccacggccuuuacuuggccgaucaguauguaaaggggauagcaaagucccgcaaaucauga

SEQ ID NO: 1871 - RNA, 1821 nt, Artificial Sequence
  derived and/or modified CDS sequence (opt3) from DENV-3 Consensus__SStPA-WHbcAg-linker-EdelTM
auggacgccaugaagagaggccugugcugugugcuccuucugugcggggcugucuucguugauagcgugaccggaauggacaucgaucccuacaaagaguuugguuccucuuaucaguuguuaaacuuccugccucuagacuuuuucccagaucucaaugcacugguagacacagccacugcgcuuuacgaagaggaacugacgggcagggagcacuguucaccgcaucacaccgcuauucggcaagccuuggugugcugggaugaacucacaaagcugauagcauggaugaguagcaacaucacuuccgagcagguccgcaccauuaucgugaaucauguuaacgacacaugggggcugaaagugcgacagucucucugguuucacuuaucgugucugaccuucggacagcauacuguccaagaguuucuugugucauucggcguauggauucguacacccgccccuuauagaccacccaaugcuccuaucuugagcacccugccagaacacacgguuauaugcggugggggaggcaguggcgggggagguaugaggugugugggcgucgggaaccgggauuuuguggagggacuauccggcgcaacuuggguggacgucguucucgaacacggugggugcgugaccacaauggccaagaauaaacccacucuggauaucgagcuucagaagaccgaggcuacacagcuggccaccuugcgcaagcucuguauugaaggaaaaaucacgaacauuacuacagacucuagaugcccuacccagggcgaggcgacucugccagaggaacaagaucagaauuacguauguaagcauacauauguggacaggggcugggggaacggaugcgguuuauucggcaaagggagccuggugaccugcgcaaaguuucagugucucgaaccgaucgagggaaaagucguucaguacgagaaucuuaaguauacggugauaauuaccguccacacaggcgaccaacaucagguggguaacgaaacucaggggguaaccgccgagaucacaccccaggcuuccacuaccgaagccauucugccugaguacggcacauugggacuagaaugcucaccacggaccggccuggauuucaaugagaugauccuccugacuaugaagaacaaagcauggaugguucaccgccaaugguuuuucgaccuuccccugccuuggacgaguggggcuacaaccgagacuccaaccuggaaucgaaaggaauugcucgugacauucaaaaacgcccacgcgaagaaacaggaggucgugguccugggaagccaggaaggugccaugcauaccgcauuaacuggcgcuacagagauccaaaacucugggggaacguccauuuuugccggccaccugaaguguagacuaaaaauggauaagcucgaacugaaggguaugucauacgcuaugugcaccaauacuuucgugcuuaaaaaggagguuagcgagacacagcaugggaccauauugaucaaaguggaauauaagggcgaggacguacccuguaaaauuccguuuaguacagaagauggacagggcaaggcccacaacgggaggcugaucacugcaaauccugucgugaccaagaaagaggagcccguuaacauagaagccgagccaccuuucggagaaucuaauauugugaucgguaucggcgacaacgcucucaagauuaauugguacaaaaagggguccagcaucggaaaaauguuugaggcgacggcacggggcgcccgucgcauggcuauucugggugauaccgccugggacuucgggucguga

SEQ ID NO: 1872 - RNA, 75 nt, Artificial Sequence
  derived and/or modified CDS sequence (opt4) from Homo sapiens__SigSeq(TPA)/SStPA
auggacgccaugaagagaggccugugcugcgugcugcugcugugcggcgccguguucguggacagcgugaccggc

SEQ ID NO: 1873 - RNA, 489 nt, Artificial Sequence
  derived and/or modified CDS sequence (opt4) from Helicobacter pylori J99__Ferritin
gacaucaucaagcugcugaacgagcaggugaacaaggagaugcagagcagcaaccuguacaugagcaugagcagcuggugcuacacccacagccuggacggcgccggccuguuccuguucgaccacgccgccgaggaguacgagcacgccaagaagcugaucaucuuccugaacgagaacaacgugcccgugcagcugaccagcaucagcgcccccgagcacaaguucgagggccugacccagaucuuccagaaggccuacgagcacgagcagcacaucagcgagagcaucaacaacaucguggaccacgccaucaagagcaaggaccacgccaccuucaacuuccugcagugguacguggccgagcagcacgaggaggaggugcuguucaaggacauccuggacaagaucgagcugaucggcaacgagaaccacggccuguaccuggccgaccaguacgugaagggcaucgccaagagcagaaagagc

SEQ ID NO: 1874 - RNA, 450 nt, Artificial Sequence
  derived and/or modified CDS sequence (opt4) from Woodchuck hepatitis virus__WHbcAg
auggacaucgaccccuacaaggaguucggcagcagcuaccagcugcugaacuuccugccccuggacuucuuccccgaccugaacgcccugguggacaccgccaccgcccuguacgaggaggagcugaccggcagagagcacugcagcccccaccacaccgccaucagacaggcccuggugugcugggacgagcugaccaagcugaucgccuggaugagcagcaacaucaccagcgagcaggugagaaccaucaucgugaaccacgugaacgacaccuggggccugaaggugagacagagccugugguuccaccugagcugccugaccuucggccagcacaccgugcaggaguuccuggugagcuucggcguguggaucagaacccccgcccccuacagaccccccaacgcccccauccugagcacccugcccgagcacaccgugaucugc

SEQ ID NO: 1875 - RNA, 303 nt, Artificial Sequence
  derived and/or modified CDS sequence (opt4) from Japanese encephalitis virus__Cterm-JEV/JEV
ggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 1876 - RNA, 15 nt, Artificial Sequence
  derived and/or modified CDS sequence (opt4) from Artificial__MKRKK
augaagagaaagaag

SEQ ID NO: 1877 - RNA, 9 nt, Artificial Sequence
  derived and/or modified CDS sequence (opt4) from Artificial__Linker(SGG)
agcggcggc

SEQ ID NO: 1878 - RNA, 27 nt, Artificial Sequence
  derived and/or modified CDS sequence (opt4) from Artificial__Linker(G4SG4)
ggcggcggcggcagcggcggcggcggc

SEQ ID NO: 1879 - RNA, 51 nt, Artificial Sequence
  derived and/or modified CDS sequence (opt4) from Foot-and-mouth disease virus__F2A/P2A
aacuucgaccugcugaagcuggccggcgacguggagagcaaccccggcccc

SEQ ID NO: 1880 - RNA, 300 nt, Artificial Sequence
  derived and/or modified CDS sequence (opt4) from DENV-1 CYD23__C
augaacaaccagagaaagaagaccgccagacccagcuucaacaugcugaagagagccagaaacagagugagcaccgugagccagcuggccaagagauucagcaagggccugcugagcggccagggccccaugaagcuggugauggccuucaucgccuuccugagauuccuggccaucccccccaccgccggcauccuggccagauggggcagcuucaagaagaacggcgccaucaaggugcugagaggcuucaagaaggagaucagcaacaugcugaacaucaugaacagaagaagaaag

SEQ ID NO: 1881 - RNA, 342 nt, Artificial Sequence
  derived and/or modified CDS sequence (opt4) from DENV-1 CYD23__C-SSc
augaacaaccagagaaagaagaccgccagacccagcuucaacaugcugaagagagccagaaacagagugagcaccgugagccagcuggccaagagauucagcaagggccugcugagcggccagggccccaugaagcuggugauggccuucaucgccuuccugagauuccuggccaucccccccaccgccggcauccuggccagauggggcagcuucaagaagaacggcgccaucaaggugcugagaggcuucaagaaggagaucagcaacaugcugaacaucaugaacagaagaagaaagagcgugaccaugcugcugaugcugaugcccaccgcccuggcc

SEQ ID NO: 1882 - RNA, 273 nt, Artificial Sequence
  derived and/or modified CDS sequence (opt4) from DENV-1 CYD23__pr
uuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagaga

SEQ ID NO: 1883 - RNA, 225 nt, Artificial Sequence
  derived and/or modified CDS sequence (opt4) from DENV-1 CYD23__M
agcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggcc

SEQ ID NO: 1884 - RNA, 498 nt, Artificial Sequence
  derived and/or modified CDS sequence (opt4) from DENV-1 CYD23__prM
uuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggcc

SEQ ID NO: 1885 - RNA, 1485 nt, Artificial Sequence
  derived and/or modified CDS sequence (opt4) from DENV-1 CYD23__E
augagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggcc

SEQ ID NO: 1886 - RNA, 1983 nt, Artificial Sequence
  derived and/or modified CDS sequence (opt4) from DENV-1 CYD23__prME
uuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggcc

SEQ ID NO: 1887 - RNA, 2025 nt, Artificial Sequence
  derived and/or modified CDS sequence (opt4) from DENV-1 CYD23__SSc-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggcc

SEQ ID NO: 1888 - RNA, 2325 nt, Artificial Sequence
  derived and/or modified CDS sequence (opt4) from DENV-1 CYD23__C-prME
augaacaaccagagaaagaagaccgccagacccagcuucaacaugcugaagagagccagaaacagagugagcaccgugagccagcuggccaagagauucagcaagggccugcugagcggccagggccccaugaagcuggugauggccuucaucgccuuccugagauuccuggccaucccccccaccgccggcauccuggccagauggggcagcuucaagaagaacggcgccaucaaggugcugagaggcuucaagaaggagaucagcaacaugcugaacaucaugaacagaagaagaaagagcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggcc

SEQ ID NO: 1889 - RNA, 45 nt, Artificial Sequence
  derived and/or modified CDS sequence (opt4) from DENV-1 CYD23__SSc
augagcgugaccaugcugcugaugcugaugcccaccgcccuggcc

SEQ ID NO: 1890 - RNA, 57 nt, Artificial Sequence
  derived and/or modified CDS sequence (opt4) from DENV-1 CYD23__SSopt
augaagagaaagaagagcgugaccaugcugcugaugcugaugcccaccgcccuggcc

SEQ ID NO: 1891 - RNA, 57 nt, Artificial Sequence
  derived and/or modified CDS sequence (opt4) from DENV-1 CYD23__SSm
augacccagaagggcaucaucuucauccugcugaugcuggugacccccagcauggcc

SEQ ID NO: 1892 - RNA, 1488 nt, Artificial Sequence
  derived and/or modified CDS sequence (opt4) from DENV-1 CYD23__E
augagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccuga

SEQ ID NO: 1893 - RNA, 1182 nt, Artificial Sequence
  derived and/or modified CDS sequence (opt4) from DENV-1 CYD23__EdelTM-variant (aa1-394)
augagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaag

SEQ ID NO: 1894 - RNA, 1275 nt, Artificial Sequence
  derived and/or modified CDS sequence (opt4) from DENV-1 CYD23__EdelTM-variant (aa1-424)
augagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcuga

SEQ ID NO: 1895 - RNA, 1266 nt, Artificial Sequence
  derived and/or modified CDS sequence (opt4) from DENV-1 CYD23__EdelTM-variant (aa1-421)
augagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuga

SEQ ID NO: 1896 - RNA, 2031 nt, Artificial Sequence
  derived and/or modified CDS sequence (opt4) from DENV-1 CYD23__SSc-prME
augagcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccuga

SEQ ID NO: 1897 - RNA, 2031 nt, Artificial Sequence
  derived and/or modified CDS sequence (opt4) from DENV-1 CYD23__SSc-prME(F108S)
augagcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccugagcggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccuga

SEQ ID NO: 1898 - RNA, 2031 nt, Artificial Sequence
  derived and/or modified CDS sequence (opt4) from DENV-1 CYD23__SSc-prMEdelstem_TM-JEV
augagcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1899 - RNA, 2379 nt, Artificial Sequence
  derived and/or modified CDS sequence (opt4) from DENV-1 CYD23__C-P2A-SSc-prME
augaacaaccagagaaagaagaccgccagacccagcuucaacaugcugaagagagccagaaacagagugagcaccgugagccagcuggccaagagauucagcaagggccugcugagcggccagggccccaugaagcuggugauggccuucaucgccuuccugagauuccuggccaucccccccaccgccggcauccuggccagauggggcagcuucaagaagaacggcgccaucaaggugcugagaggcuucaagaaggagaucagcaacaugcugaacaucaugaacagaagaagaaagaacuucgaccugcugaagcuggccggcgacguggagagcaaccccggccccagcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccuga

SEQ ID NO: 1900 - RNA, 2043 nt, Artificial Sequence
  derived and/or modified CDS sequence (opt4) from DENV-1 CYD23__SSopt-prME(F108S)
augaagagaaagaagagcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccugagcggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccuga

SEQ ID NO: 1901 - RNA, 2043 nt, Artificial Sequence
  derived and/or modified CDS sequence (opt4) from DENV-1 CYD23__SSopt-prME(F96H)
augaagagaaagaagagcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaacccacguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccuga

SEQ ID NO: 1902 - RNA, 2043 nt, Artificial Sequence
  derived and/or modified CDS sequence (opt4) from DENV-1 CYD23__SSopt-prME(S186F)
augaagagaaagaagagcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcuuccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccuga

SEQ ID NO: 1903 - RNA, 2043 nt, Artificial Sequence
  derived and/or modified CDS sequence (opt4) from DENV-1 CYD23__SSopt-prME(R188L)
augaagagaaagaagagcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagcccccugaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccuga

SEQ ID NO: 1904 - RNA, 2043 nt, Artificial Sequence
  derived and/or modified CDS sequence (opt4) from DENV-1 CYD23__SSopt-pr(D104A)MEdelstem_TM,(F108S)-JEV
augaagagaaagaagagcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagccaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccugagcggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1905 - RNA, 2043 nt, Artificial Sequence
  derived and/or modified CDS sequence (opt4) from DENV-1 CYD23__SSopt-prMEdelstem_TM,(H261N)-JEV
augaagagaaagaagagcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugaacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1906 - RNA, 2043 nt, Artificial Sequence
  derived and/or modified CDS sequence (opt4) from DENV-1 CYD23__SSopt-prMEdelstem_TM,(R188L,A267T)-JEV
augaagagaaagaagagcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagcccccugaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcaccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1907 - RNA, 300 nt, Artificial Sequence
  derived and/or modified CDS sequence (opt4) from DENV-2 CYD2-T__C
augaacaaccagagaaagaaggccaagaacacccccuucaacaugcugaagagagagagaaacagagugagcaccgugcagcagcugaccaagagauucagccugggcaugcugcagggcagaggcccccugaagcuguucauggcccugguggccuuccugagauuccugaccaucccccccaccgccggcauccugaagagauggggcaccaucaagaagagcaaggccaucaacgugcugagaggcuucagaaaggagaucggcagaaugcugaacauccugaacagaagaagaaga

SEQ ID NO: 1908 - RNA, 342 nt, Artificial Sequence
  derived and/or modified CDS sequence (opt4) from DENV-2 CYD2-T__C-SSc
augaacaaccagagaaagaaggccaagaacacccccuucaacaugcugaagagagagagaaacagagugagcaccgugcagcagcugaccaagagauucagccugggcaugcugcagggcagaggcccccugaagcuguucauggcccugguggccuuccugagauuccugaccaucccccccaccgccggcauccugaagagauggggcaccaucaagaagagcaaggccaucaacgugcugagaggcuucagaaaggagaucggcagaaugcugaacauccugaacagaagaagaagaagcgccggcaugaucaucaugcugauccccaccgugauggcc

SEQ ID NO: 1909 - RNA, 273 nt, Artificial Sequence
  derived and/or modified CDS sequence (opt4) from DENV-2 CYD2-T__pr
uuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagaga

SEQ ID NO: 1910 - RNA, 225 nt, Artificial Sequence
  derived and/or modified CDS sequence (opt4) from DENV-2 CYD2-T__M
agcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugacc

SEQ ID NO: 1911 - RNA, 498 nt, Artificial Sequence
  derived and/or modified CDS sequence (opt4) from DENV-2 CYD2-T__prM
uuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugacc

SEQ ID NO: 1912 - RNA, 1485 nt, Artificial Sequence
  derived and/or modified CDS sequence (opt4) from DENV-2 CYD2-T__E
augagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggcc

SEQ ID NO: 1913 - RNA, 1983 nt, Artificial Sequence
  derived and/or modified CDS sequence (opt4) from DENV-2 CYD2-T__prME
uuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggcc

SEQ ID NO: 1914 - RNA, 2025 nt, Artificial Sequence
  derived and/or modified CDS sequence (opt4) from DENV-2 CYD2-T__SSc-prME
agcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggcc

SEQ ID NO: 1915 - RNA, 2325 nt, Artificial Sequence
  derived and/or modified CDS sequence (opt4) from DENV-2 CYD2-T__C-prME
augaacaaccagagaaagaaggccaagaacacccccuucaacaugcugaagagagagagaaacagagugagcaccgugcagcagcugaccaagagauucagccugggcaugcugcagggcagaggcccccugaagcuguucauggcccugguggccuuccugagauuccugaccaucccccccaccgccggcauccugaagagauggggcaccaucaagaagagcaaggccaucaacgugcugagaggcuucagaaaggagaucggcagaaugcugaacauccugaacagaagaagaagaagcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggcc

SEQ ID NO: 1916 - RNA, 45 nt, Artificial Sequence; identical to SEQ ID NO: 1304
  derived and/or modified CDS sequence (opt4) from DENV-2 CYD2-T__SSc

SEQ ID NO: 1917 - RNA, 57 nt, Artificial Sequence
  derived and/or modified CDS sequence (opt4) from DENV-2 CYD2-T__SSopt
augaagagaaagaagagcgccggcaugaucaucaugcugauccccaccgugauggcc

SEQ ID NO: 1918 - RNA, 57 nt, Artificial Sequence
  derived and/or modified CDS sequence (opt4) from DENV-2 CYD2-T__SSm
auguuccagagagcccugaucuucauccugcugaccgccgugacccccagcaugacc

SEQ ID NO: 1919 - RNA, 1488 nt, Artificial Sequence
  derived and/or modified CDS sequence (opt4) from DENV-2 CYD2-T__E
augagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggccuga

SEQ ID NO: 1920 - RNA, 1182 nt, Artificial Sequence
  derived and/or modified CDS sequence (opt4) from DENV-2 CYD2-T__EdelTM-variant (aa1-394)
augagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaag

SEQ ID NO: 1921 - RNA, 1272 nt, Artificial Sequence
  derived and/or modified CDS sequence (opt4) from DENV-2 CYD2-T__EdelTM-variant (aa1-424)
augagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagc

SEQ ID NO: 1922 - RNA, 1263 nt, Artificial Sequence
  derived and/or modified CDS sequence (opt4) from DENV-2 CYD2-T__EdelTM-variant (aa1-421)
augagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggac

SEQ ID NO: 1923 - RNA, 2031 nt, Artificial Sequence
  derived and/or modified CDS sequence (opt4) from DENV-2 CYD2-T__SSc-prME
augagcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggccuga

SEQ ID NO: 1924 - RNA, 2031 nt, Artificial Sequence
  derived and/or modified CDS sequence (opt4) from DENV-2 CYD2-T__SSc-prME(F108S)
augagcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccugagcggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggccuga

SEQ ID NO: 1925 - RNA, 2031 nt, Artificial Sequence
  derived and/or modified CDS sequence (opt4) from DENV-2 CYD2-T__SSc-prMEdelstem_TM-JEV
augagcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1926 - RNA, 1332 nt, Artificial Sequence
  derived and/or modified CDS sequence (opt4) from DENV-2 CYD2-T__SSm-EdelTM
auguuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagcuga

SEQ ID NO: 1927 - RNA, 2379 nt, Artificial Sequence
  derived and/or modified CDS sequence (opt4) from DENV-2 CYD2-T__C-P2A-SSc-prME
augaacaaccagagaaagaaggccaagaacacccccuucaacaugcugaagagagagagaaacagagugagcaccgugcagcagcugaccaagagauucagccugggcaugcugcagggcagaggcccccugaagcuguucauggcccugguggccuuccugagauuccugaccaucccccccaccgccggcauccugaagagauggggcaccaucaagaagagcaaggccaucaacgugcugagaggcuucagaaaggagaucggcagaaugcugaacauccugaacagaagaagaagaaacuucgaccugcugaagcuggccggcgacguggagagcaaccccggccccagcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggccuga

SEQ ID NO: 1928 - RNA, 2043 nt, Artificial Sequence
  derived and/or modified CDS sequence (opt4) from DENV-2 CYD2-T__SSopt-prME(F108S)
augaagagaaagaagagcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccugagcggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggccuga

SEQ ID NO: 1929 - RNA, 2043 nt, Artificial Sequence
  derived and/or modified CDS sequence (opt4) from DENV-2 CYD2-T__SSopt-prME(M96H)
augaagagaaagaagagcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagccacguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggccuga

SEQ ID NO: 1930 - RNA, 2043 nt, Artificial Sequence
  derived and/or modified CDS sequence (opt4) from DENV-2 CYD2-T__SSopt-prME(S186F)
augaagagaaagaagagcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcuuccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggccuga

SEQ ID NO: 1931 - RNA, 2043 nt, Artificial Sequence
  derived and/or modified CDS sequence (opt4) from DENV-2 CYD2-T__SSopt-prME(R188L)
augaagagaaagaagagcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagcccccugaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugacccuggugcuggugggcaucgugacccuguaccugggcgugauggugcaggccuga

SEQ ID NO: 1932 - RNA, 2043 nt, Artificial Sequence
  derived and/or modified CDS sequence (opt4) from DENV-2 CYD2-T__SSopt-pr(D104A)MEdelstem_TM,(F108S)-JEV
augaagagaaagaagagcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagccaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccugagcggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1933 - RNA, 2043 nt, Artificial Sequence
  derived and/or modified CDS sequence (opt4) from DENV-2 CYD2-T__SSopt-prMEdelstem_TM,(H261N)-JEV
augaagagaaagaagagcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugaacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1934 - RNA, 2043 nt, Artificial Sequence
  derived and/or modified CDS sequence (opt4) from DENV-2 CYD2-T__SSopt-prMEdelstem_TM,(R188L,A267T)-JEV
augaagagaaagaagagcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaugggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaugauggccgccauccuggccuacaccaucggcaccacccacuuccagagagcccugaucuucauccugcugaccgccgugacccccagcaugaccaugagaugcaucggcaugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucagaugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagcccccugaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcaccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1935 - RNA, 297 nt, Artificial Sequence
  derived and/or modified CDS sequence (opt4) from DENV-4 Consensus__C
augaaccagagaaagaagguggugagaccccccuucaacaugcugaagagagagagaaacagagugagcaccccccagggccuggugaagagauucagcaccggccuguucagcggcaagggcccccugagaauggugcuggccuucaucaccuuccugagagugcugagcaucccccccaccgccggcauccugaagagauggggccagcugaagaagaacaaggccaucaagauccugaucggcuucagaaaggagaucggcagaaugcugaacauccugaacggcagaaagaga

SEQ ID NO: 1936 - RNA, 339 nt, Artificial Sequence
  derived and/or modified CDS sequence (opt4) from DENV-4 Consensus__C-SSc
augaaccagagaaagaagguggugagaccccccuucaacaugcugaagagagagagaaacagagugagcaccccccagggccuggugaagagauucagcaccggccuguucagcggcaagggcccccugagaauggugcuggccuucaucaccuuccugagagugcugagcaucccccccaccgccggcauccugaagagauggggccagcugaagaagaacaaggccaucaagauccugaucggcuucagaaaggagaucggcagaaugcugaacauccugaacggcagaaagagaagcaccaucacccugcugugccugauccccaccgugauggcc

SEQ ID NO: 1937 - RNA, 273 nt, Artificial Sequence
  derived and/or modified CDS sequence (opt4) from DENV-4 Consensus__pr
uuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagaga

SEQ ID NO: 1938 - RNA, 225 nt, Artificial Sequence
  derived and/or modified CDS sequence (opt4) from DENV-4 Consensus__M
agcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggc

SEQ ID NO: 1939 - RNA, 498 nt, Artificial Sequence
  derived and/or modified CDS sequence (opt4) from DENV-4 Consensus__prM
uuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggc

SEQ ID NO: 1940 - RNA, 1485 nt, Artificial Sequence
  derived and/or modified CDS sequence (opt4) from DENV-4 Consensus__E
augagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggcc

SEQ ID NO: 1941 - RNA, 1983 nt, Artificial Sequence
  derived and/or modified CDS sequence (opt4) from DENV-4 Consensus__prME
uuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggcc

SEQ ID NO: 1942 - RNA, 2025 nt, Artificial Sequence
  derived and/or modified CDS sequence (opt4) from DENV-4 Consensus__SSc-prME
agcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggcc

SEQ ID NO: 1943 - RNA, 2322 nt, Artificial Sequence
  derived and/or modified CDS sequence (opt4) from DENV-4 Consensus__C-prME
augaaccagagaaagaagguggugagaccccccuucaacaugcugaagagagagagaaacagagugagcaccccccagggccuggugaagagauucagcaccggccuguucagcggcaagggcccccugagaauggugcuggccuucaucaccuuccugagagugcugagcaucccccccaccgccggcauccugaagagauggggccagcugaagaagaacaaggccaucaagauccugaucggcuucagaaaggagaucggcagaaugcugaacauccugaacggcagaaagagaagcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggcc

SEQ ID NO: 1944 - RNA, 45 nt, Artificial Sequence
  derived and/or modified CDS sequence (opt4) from DENV-4 Consensus__SSc
augagcaccaucacccugcugugccugauccccaccgugauggcc

SEQ ID NO: 1945 - RNA, 57 nt, Artificial Sequence
  derived and/or modified CDS sequence (opt4) from DENV-4 Consensus__SSopt
augaagagaaagaagagcaccaucacccugcugugccugauccccaccgugauggcc

SEQ ID NO: 1946 - RNA, 57 nt, Artificial Sequence
  derived and/or modified CDS sequence (opt4) from DENV-4 Consensus__SSm
augauccagagaaccguguucuucgugcugaugaugcugguggcccccagcuacggc

SEQ ID NO: 1947 - RNA, 1488 nt, Artificial Sequence
  derived and/or modified CDS sequence (opt4) from DENV-4 Consensus__E
augagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccuga

SEQ ID NO: 1948 - RNA, 1182 nt, Artificial Sequence
  derived and/or modified CDS sequence (opt4) from DENV-4 Consensus__EdelTM-variant (aa1-394)
augagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaag

SEQ ID NO: 1949 - RNA, 1272 nt, Artificial Sequence
  derived and/or modified CDS sequence (opt4) from DENV-4 Consensus__EdelTM-variant (aa1-424)
augagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagc

SEQ ID NO: 1950 - RNA, 1266 nt, Artificial Sequence
  derived and/or modified CDS sequence (opt4) from DENV-4 Consensus__EdelTM-variant (aa1-421)
augagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuga

SEQ ID NO: 1951 - RNA, 2031 nt, Artificial Sequence
  derived and/or modified CDS sequence (opt4) from DENV-4 Consensus__SSc-prME
augagcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccuga

SEQ ID NO: 1952 - RNA, 2031 nt, Artificial Sequence
  derived and/or modified CDS sequence (opt4) from DENV-4 Consensus__SSc-prME(F108S)
augagcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccugagcggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccuga

SEQ ID NO: 1953 - RNA, 2031 nt, Artificial Sequence
  derived and/or modified CDS sequence (opt4) from DENV-4 Consensus__SSc-prMEdelstem_TM-JEV
augagcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1954 - RNA, 1332 nt, Artificial Sequence
  derived and/or modified CDS sequence (opt4) from DENV-4 Consensus__SSm-EdelTM
augauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcuga

SEQ ID NO: 1955 - RNA, 2376 nt, Artificial Sequence
  derived and/or modified CDS sequence (opt4) from DENV-4 Consensus__C-P2A-SSc-prME
augaaccagagaaagaagguggugagaccccccuucaacaugcugaagagagagagaaacagagugagcaccccccagggccuggugaagagauucagcaccggccuguucagcggcaagggcccccugagaauggugcuggccuucaucaccuuccugagagugcugagcaucccccccaccgccggcauccugaagagauggggccagcugaagaagaacaaggccaucaagauccugaucggcuucagaaaggagaucggcagaaugcugaacauccugaacggcagaaagagaaacuucgaccugcugaagcuggccggcgacguggagagcaaccccggccccagcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccuga

SEQ ID NO: 1956 - RNA, 2043 nt, Artificial Sequence
  derived and/or modified CDS sequence (opt4) from DENV-4 Consensus__SSopt-prME(F108S)
augaagagaaagaagagcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccugagcggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccuga

SEQ ID NO: 1957 - RNA, 2043 nt, Artificial Sequence
  derived and/or modified CDS sequence (opt4) from DENV-4 Consensus__SSopt-prME(V96H)
augaagagaaagaagagcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagaccacguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccuga

SEQ ID NO: 1958 - RNA, 2043 nt, Artificial Sequence
  derived and/or modified CDS sequence (opt4) from DENV-4 Consensus__SSopt-prME(E186F)
augaagagaaagaagagcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcuuccccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccuga

SEQ ID NO: 1959 - RNA, 2043 nt, Artificial Sequence
  derived and/or modified CDS sequence (opt4) from DENV-4 Consensus__SSopt-prME(R188L)
augaagagaaagaagagcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagccccugagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcagcaucggcaagauguucgagagcaccuacagaggcgccaagagaauggccauccugggcgagaccgccugggacuucggcagcgugggcggccuguucaccagccugggcaaggccgugcaccagguguucggcagcguguacaccaccauguucggcggcgugagcuggaugaucagaauccugaucggcuuccuggugcuguggaucggcaccaacagcagaaacaccagcauggccaugaccugcaucgccgugggcggcaucacccuguuccugggcuucaccgugcaggccuga

SEQ ID NO: 1960 - RNA, 2043 nt, Artificial Sequence
  derived and/or modified CDS sequence (opt4) from DENV-4 Consensus__SSopt-pr(D104A)MEdelstem_TM,(F108S)-JEV
augaagagaaagaagagcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagccaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccugagcggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1961 - RNA, 2043 nt, Artificial Sequence
  derived and/or modified CDS sequence (opt4) from DENV-4 Consensus__SSopt-prMEdelstem_TM,(H261N)-JEV
augaagagaaagaagagcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagcccagaagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugaacagcgcccuggccggcgccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1962 - RNA, 2043 nt, Artificial Sequence
  derived and/or modified CDS sequence (opt4) from DENV-4 Consensus__SSopt-prMEdelstem_TM,(R188L,A267T)-JEV
augaagagaaagaagagcaccaucacccugcugugccugauccccaccgugauggccuuccaccugagcaccagagacggcgagccccugaugaucguggccaagcacgagagaggcagaccccugcuguucaagaccaccgagggcaucaacaagugcacccugaucgccauggaccugggcgagaugugcgaggacaccgugaccuacaagugcccccugcuggugaacaccgagcccgaggacaucgacugcuggugcaaccugaccagcaccugggugauguacggcaccugcacccagagcggcgagagaagaagagagaagagaagcguggcccugaccccccacagcggcaugggccuggagaccagagccgagaccuggaugagcagcgagggcgccuggaagcacgcccagagaguggagagcuggauccugagaaaccccggcuucgcccugcuggccggcuucauggccuacaugaucggccagaccggcauccagagaaccguguucuucgugcugaugaugcugguggcccccagcuacggcaugagaugcgugggcgugggcaacagagacuucguggagggcgugagcggcggcgccuggguggaccuggugcuggagcacggcggcugcgugaccaccauggcccagggcaagcccacccuggacuucgagcugaccaagaccaccgccaaggagguggcccugcugagaaccuacugcaucgaggccagcaucagcaacaucaccaccgccaccagaugccccacccagggcgagcccuaccugaaggaggagcaggaccagcaguacaucugcagaagagacgugguggacagaggcuggggcaacggcugcggccuguucggcaagggcggcguggugaccugcgccaaguucagcugcagcggcaagaucaccggcaaccuggugcagaucgagaaccuggaguacaccgugguggugaccgugcacaacggcgacacccacgccgugggcaacgacaccagcaaccacggcgugaccgccaccaucacccccagaagccccagcguggaggugaagcugcccgacuacggcgagcugacccuggacugcgagccccugagcggcaucgacuucaacgagaugauccugaugaagaugaagaagaagaccuggcuggugcacaagcagugguuccuggaccugccccugcccuggaccgccggcgccgacaccagcgaggugcacuggaacuacaaggagagaauggugaccuucaaggugccccacgccaagagacaggacgugaccgugcugggcagccaggagggcgccaugcacagcgcccuggccggcaccaccgagguggacagcggcgacggcaaccacauguucgccggccaccugaagugcaaggugagaauggagaagcugagaaucaagggcaugagcuacaccaugugcagcggcaaguucagcaucgacaaggagauggccgagacccagcacggcaccaccguggugaaggugaaguacgagggcgccggcgcccccugcaaggugcccaucgagaucagagacgugaacaaggagaagguggugggcagagugaucagcagcaccccccuggccgagaacaccaacagcgugaccaacaucgagcuggagccccccuucggcgacagcuacaucgugaucggcgugggcaacagcgcccugacccugcacugguucagaaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1963 - RNA, 300 nt, Artificial Sequence
  derived and/or modified CDS sequence (opt4) from DENV-3 Consensus__C
augaacaaccagagaaagaagaccggcaagcccagcaucaacaugcugaagagagugagaaacagagugagcaccggcagccagcuggccaagagauucagcaagggccugcugaacggccagggccccaugaagcuggugauggccuucaucgccuuccugagauuccuggccaucccccccaccgccggcgugcuggccagauggggcaccuucaagaagagcggcgccaucaaggugcugaagggcuucaagaaggagaucagcaacaugcugagcaucaucaacaagagaaagaag

SEQ ID NO: 1964 - RNA, 342 nt, Artificial Sequence
  derived and/or modified CDS sequence (opt4) from DENV-3 Consensus__C-SSc
augaacaaccagagaaagaagaccggcaagcccagcaucaacaugcugaagagagugagaaacagagugagcaccggcagccagcuggccaagagauucagcaagggccugcugaacggccagggccccaugaagcuggugauggccuucaucgccuuccugagauuccuggccaucccccccaccgccggcgugcuggccagauggggcaccuucaagaagagcggcgccaucaaggugcugaagggcuucaagaaggagaucagcaacaugcugagcaucaucaacaagagaaagaagaccagccugugccugaugaugauccugcccgccgcccuggcc

SEQ ID NO: 1965 - RNA, 273 nt, Artificial Sequence
  derived and/or modified CDS sequence (opt4) from DENV-3 Consensus__pr
uuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagaga

SEQ ID NO: 1966 - RNA, 225 nt, Artificial Sequence
  derived and/or modified CDS sequence (opt4) from DENV-3 Consensus__M
agcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugacc

SEQ ID NO: 1967 - RNA, 498 nt, Artificial Sequence
  derived and/or modified CDS sequence (opt4) from DENV-3 Consensus__prM
uuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugacc

SEQ ID NO: 1968 - RNA, 1479 nt, Artificial Sequence
  derived and/or modified CDS sequence (opt4) from DENV-3 Consensus__E
augagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggcc

SEQ ID NO: 1969 - RNA, 1977 nt, Artificial Sequence
  derived and/or modified CDS sequence (opt4) from DENV-3 Consensus__prME
uuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggcc

SEQ ID NO: 1970 - RNA, 2019 nt, Artificial Sequence
  derived and/or modified CDS sequence (opt4) from DENV-3 Consensus__SSc-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggcc

SEQ ID NO: 1971 - RNA, 1056 nt, Artificial Sequence
  derived and/or modified CDS sequence (opt4) from DENV-3 Consensus__NS1
gacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgcc

SEQ ID NO: 1972 - RNA, 1857 nt, Artificial Sequence
  derived and/or modified CDS sequence (opt4) from DENV-3 Consensus__NS3
agcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaag

SEQ ID NO: 1973 - RNA, 2319 nt, Artificial Sequence
  derived and/or modified CDS sequence (opt4) from DENV-3 Consensus__C-prME
augaacaaccagagaaagaagaccggcaagcccagcaucaacaugcugaagagagugagaaacagagugagcaccggcagccagcuggccaagagauucagcaagggccugcugaacggccagggccccaugaagcuggugauggccuucaucgccuuccugagauuccuggccaucccccccaccgccggcgugcuggccagauggggcaccuucaagaagagcggcgccaucaaggugcugaagggcuucaagaaggagaucagcaacaugcugagcaucaucaacaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggcc

SEQ ID NO: 1974 - RNA, 45 nt, Artificial Sequence
  derived and/or modified CDS sequence (opt4) from DENV-3 Consensus__SSc
augaccagccugugccugaugaugauccugcccgccgcccuggcc

SEQ ID NO: 1975 - RNA, 57 nt, Artificial Sequence
  derived and/or modified CDS sequence (opt4) from DENV-3 Consensus__SSopt
augaagagaaagaagaccagccugugccugaugaugauccugcccgccgcccuggcc

SEQ ID NO: 1976 - RNA, 57 nt, Artificial Sequence
  derived and/or modified CDS sequence (opt4) from DENV-3 Consensus__SSm
augacccagaagguggugaucuucauccugcugaugcuggugacccccagcaugacc

SEQ ID NO: 1977 - RNA, 1482 nt, Artificial Sequence
  derived and/or modified CDS sequence (opt4) from DENV-3 Consensus__E
augagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1978 - RNA, 1176 nt, Artificial Sequence
  derived and/or modified CDS sequence (opt4) from DENV-3 Consensus__EdelTM-variant (aa1-392)
augagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaag

SEQ ID NO: 1979 - RNA, 1269 nt, Artificial Sequence
  derived and/or modified CDS sequence (opt4) from DENV-3 Consensus__EdelTM-variant (aa1-422)
augagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcuga

SEQ ID NO: 1980 - RNA, 1260 nt, Artificial Sequence
  derived and/or modified CDS sequence (opt4) from DENV-3 Consensus__EdelTM-variant (aa1-419)
augagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuga

SEQ ID NO: 1981 - RNA, 1155 nt, Artificial Sequence
  derived and/or modified CDS sequence (opt4) from DENV-3 Consensus__Edelaa101-107
augagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaag

SEQ ID NO: 1982 - RNA, 1173 nt, Artificial Sequence
  derived and/or modified CDS sequence (opt4) from DENV-3 Consensus__EdelTM-variant (aa1-391)
augagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaag

SEQ ID NO: 1983 - RNA, 2025 nt, Artificial Sequence
  derived and/or modified CDS sequence (opt4) from DENV-3 Consensus__SSc-prME
augaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1984 - RNA, 2025 nt, Artificial Sequence
  derived and/or modified CDS sequence (opt4) from DENV-3 Consensus__SSc-prME(F108S)
augaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccugagcggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1985 - RNA, 2025 nt, Artificial Sequence
  derived and/or modified CDS sequence (opt4) from DENV-3 Consensus__SSc-prME(R186L)
augaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagcccccugaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1986 - RNA, 2025 nt, Artificial Sequence
  derived and/or modified CDS sequence (opt4) from DENV-3 Consensus__SSc-prME(A265T)
augaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcaccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1987 - RNA, 2025 nt, Artificial Sequence
  derived and/or modified CDS sequence (opt4) from DENV-3 Consensus__SSc-prMEdelstem_TM-JEV
augaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 1988 - RNA, 1326 nt, Artificial Sequence
  derived and/or modified CDS sequence (opt4) from DENV-3 Consensus__SSm-EdelTM
augacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcuga

SEQ ID NO: 1989 - RNA, 2373 nt, Artificial Sequence
  derived and/or modified CDS sequence (opt4) from DENV-3 Consensus__C-P2A-SSc-prME
augaacaaccagagaaagaagaccggcaagcccagcaucaacaugcugaagagagugagaaacagagugagcaccggcagccagcuggccaagagauucagcaagggccugcugaacggccagggccccaugaagcuggugauggccuucaucgccuuccugagauuccuggccaucccccccaccgccggcgugcuggccagauggggcaccuucaagaagagcggcgccaucaaggugcugaagggcuucaagaaggagaucagcaacaugcugagcaucaucaacaagagaaagaagaacuucgaccugcugaagcuggccggcgacguggagagcaaccccggccccaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1990 - RNA, 2037 nt, Artificial Sequence
  derived and/or modified CDS sequence (opt4) from DENV-3 Consensus__SSopt-prME
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1991 - RNA, 2037 nt, Artificial Sequence
  derived and/or modified CDS sequence (opt4) from DENV-3 Consensus__SSopt-prME(F108S)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccugagcggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1992 - RNA, 2037 nt, Artificial Sequence
  derived and/or modified CDS sequence (opt4) from DENV-3 Consensus__SSopt-prME(H27N)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagaacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1993 - RNA, 2037 nt, Artificial Sequence
  derived and/or modified CDS sequence (opt4) from DENV-3 Consensus__SSopt-prME(T76I)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccauccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1994 - RNA, 2037 nt, Artificial Sequence
  derived and/or modified CDS sequence (opt4) from DENV-3 Consensus__SSopt-prME(N89D)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccaggacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1995 - RNA, 2037 nt, Artificial Sequence
  derived and/or modified CDS sequence (opt4) from DENV-3 Consensus__SSopt-prME(Y96H)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacacccacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1996 - RNA, 2037 nt, Artificial Sequence
  derived and/or modified CDS sequence (opt4) from DENV-3 Consensus__SSopt-prME(K110E)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcgagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1997 - RNA, 2037 nt, Artificial Sequence
  derived and/or modified CDS sequence (opt4) from DENV-3 Consensus__SSopt-prME(H149N)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagaaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1998 - RNA, 2037 nt, Artificial Sequence
  derived and/or modified CDS sequence (opt4) from DENV-3 Consensus__SSopt-prME(S184F)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcuuccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 1999 - RNA, 2037 nt, Artificial Sequence
  derived and/or modified CDS sequence (opt4) from DENV-3 Consensus__SSopt-prME(R186L)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagcccccugaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2000 - RNA, 2037 nt, Artificial Sequence
  derived and/or modified CDS sequence (opt4) from DENV-3 Consensus__SSopt-prME(N240S)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagagcgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2001 - RNA, 2037 nt, Artificial Sequence
  derived and/or modified CDS sequence (opt4) from DENV-3 Consensus__SSopt-prME(M258L)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgcccugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2002 - RNA, 2037 nt, Artificial Sequence
  derived and/or modified CDS sequence (opt4) from DENV-3 Consensus__SSopt-prME(H259N)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugaacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2003 - RNA, 2037 nt, Artificial Sequence
  derived and/or modified CDS sequence (opt4) from DENV-3 Consensus__SSopt-prME(H259R)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugagaaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2004 - RNA, 2037 nt, Artificial Sequence
  derived and/or modified CDS sequence (opt4) from DENV-3 Consensus__SSopt-prME(A265T)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcaccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2005 - RNA, 2037 nt, Artificial Sequence
  derived and/or modified CDS sequence (opt4) from DENV-3 Consensus__SSopt-prME(S296G)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugggcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2006 - RNA, 2037 nt, Artificial Sequence
  derived and/or modified CDS sequence (opt4) from DENV-3 Consensus__SSopt-prME(S311R)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagagagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2007 - RNA, 2037 nt, Artificial Sequence
  derived and/or modified CDS sequence (opt4) from DENV-3 Consensus__SSopt-prME(K321T)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaccguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2008 - RNA, 2037 nt, Artificial Sequence
  derived and/or modified CDS sequence (opt4) from DENV-3 Consensus__SSopt-prME(G28C,H242C)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacugcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgccugcgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2009 - RNA, 2037 nt, Artificial Sequence
  derived and/or modified CDS sequence (opt4) from DENV-3 Consensus__SSopt-prME(R186L,A265T)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagcccccugaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcaccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2010 - RNA, 2037 nt, Artificial Sequence
  derived and/or modified CDS sequence (opt4) from DENV-3 Consensus__SSopt-pr(D104A)ME(F108S)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagccaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccugagcggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2011 - RNA, 2037 nt, Artificial Sequence
  derived and/or modified CDS sequence (opt4) from DENV-3 Consensus__SSopt-pr(D104A)ME(R186L,A265T)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagccaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagcccccugaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcaccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2012 - RNA, 2037 nt, Artificial Sequence
  derived and/or modified CDS sequence (opt4) from DENV-3 Consensus__SSopt-pr(D104A)ME(F108S,R186L,A265T)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagccaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccugagcggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagcccccugaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcaccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2013 - RNA, 2016 nt, Artificial Sequence
  derived and/or modified CDS sequence (opt4) from DENV-3 Consensus__SSopt-prMEdel101-107,(R99P,F108N)
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggaccccggcaacggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccuga

SEQ ID NO: 2014 - RNA, 2037 nt, Artificial Sequence
  derived and/or modified CDS sequence (opt4) from DENV-3 Consensus__SSopt-prMEdelstem_TM-JEV
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 2015 - RNA, 2037 nt, Artificial Sequence
  derived and/or modified CDS sequence (opt4) from DENV-3 Consensus__SSopt-pr(D104A)MEdelstem_TM,(F108S)-JEV
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagccaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccugagcggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 2016 - RNA, 2037 nt, Artificial Sequence
  derived and/or modified CDS sequence (opt4) from DENV-3 Consensus__SSopt-pr(D104A)MEdelstem_TM,(R186L,A265T)-JEV
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagccaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagcccccugaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcaccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 2017 - RNA, 2037 nt, Artificial Sequence
  derived and/or modified CDS sequence (opt4) from DENV-3 Consensus__SSopt-pr(D104A)MEdelstem_TM,(F108S,R186L,A265T)-JEV
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagccaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccugagcggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagcccccugaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcaccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 2018 - RNA, 2037 nt, Artificial Sequence
  derived and/or modified CDS sequence (opt4) from DENV-3 Consensus__SSopt-prMEdelstem_TM,(H259N)-JEV
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugaacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 2019 - RNA, 2037 nt, Artificial Sequence
  derived and/or modified CDS sequence (opt4) from DENV-3 Consensus__SSopt-prMEdelstem_TM,(R186L,A265T)-JEV
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagcccccugaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcaccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 2020 - RNA, 2016 nt, Artificial Sequence
  derived and/or modified CDS sequence (opt4) from DENV-3 Consensus__SSopt-prMEdelstem_TM,del101-107,(R99P,F108N)-JEV
augaagagaaagaagaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggaccccggcaacggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccuga

SEQ ID NO: 2021 - RNA, 3081 nt, Artificial Sequence
  derived and/or modified CDS sequence (opt4) from DENV-3 Consensus__SSc-prME-NS1
augaccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccuga

SEQ ID NO: 2022 - RNA, 1824 nt, Artificial Sequence
  derived and/or modified CDS sequence (opt4) from DENV-3 Consensus__SSm-EdelTM-linker-ferritin
augacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcagcggcggcgacaucaucaagcugcugaacgagcaggugaacaaggagaugcagagcagcaaccuguacaugagcaugagcagcuggugcuacacccacagccuggacggcgccggccuguuccuguucgaccacgccgccgaggaguacgagcacgccaagaagcugaucaucuuccugaacgagaacaacgugcccgugcagcugaccagcaucagcgcccccgagcacaaguucgagggccugacccagaucuuccagaaggccuacgagcacgagcagcacaucagcgagagcaucaacaacaucguggaccacgccaucaagagcaaggaccacgccaccuucaacuuccugcagugguacguggccgagcagcacgaggaggaggugcuguucaaggacauccuggacaagaucgagcugaucggcaacgagaaccacggccuguaccuggccgaccaguacgugaagggcaucgccaagagcagaaagagcuga

SEQ ID NO: 2023 - RNA, 1821 nt, Artificial Sequence
  derived and/or modified CDS sequence (opt4) from DENV-3 Consensus__SStPA-WHbcAg-linker-EdelTM
auggacgccaugaagagaggccugugcugcgugcugcugcugugcggcgccguguucguggacagcgugaccggcauggacaucgaccccuacaaggaguucggcagcagcuaccagcugcugaacuuccugccccuggacuucuuccccgaccugaacgcccugguggacaccgccaccgcccuguacgaggaggagcugaccggcagagagcacugcagcccccaccacaccgccaucagacaggcccuggugugcugggacgagcugaccaagcugaucgccuggaugagcagcaacaucaccagcgagcaggugagaaccaucaucgugaaccacgugaacgacaccuggggccugaaggugagacagagccugugguuccaccugagcugccugaccuucggccagcacaccgugcaggaguuccuggugagcuucggcguguggaucagaacccccgcccccuacagaccccccaacgcccccauccugagcacccugcccgagcacaccgugaucugcggcggcggcggcagcggcggcggcggcaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcuga

SEQ ID NO: 2024 - RNA, 75 nt, Artificial Sequence
  derived and/or modified CDS sequence (opt5) from Homo sapiens__SigSeq(TPA)/SStPA
auggacgccaugaagagaggccugugcugugugcuccugcuuugcggggcugucuucguugauagcgugaccgga

SEQ ID NO: 2025 - RNA, 489 nt, Artificial Sequence
  derived and/or modified CDS sequence (opt5) from Helicobacter pylori J99__Ferritin
gacaucauuaagcugcucaacgaacaggugaauaaagagaugcaaagcuccaaccuguacaugucuaugagcuccuggugcuauacccacucucuugauggcgccgggcuguuccucuuugaccaugcugccgaggaauacgagcacgcgaagaaacugaucauuuuccuuaaugaaaacaauguccccguucagcugacaagcaucuccgcuccugagcauaaguuugagggacucacgcagauuuuccagaaagccuaugaacacgagcaacauaucucugaaagcaucaacaauauuguggaucacgccaucaaguccaaggaccacgcuaccuuuaacuuccugcagugguacguggccgagcagcaugaggaagagguccuguuuaaagauauucucgacaagaucgaacugauuggcaaugagaaccacgggcuuuaucuggcugaucaguacgugaaaggaaucgccaagagcagaaaaucu

SEQ ID NO: 2026 - RNA, 450 nt, Artificial Sequence
  derived and/or modified CDS sequence (opt5) from Woodchuck hepatitis virus__WHbcAg
auggacaucgaucccuacaaggaguucggcagcuccuaucagcugcucaacuuucugccucuugacuucuuuccggaucugaaugcccucguggacaccgcuacagcccuguacgaagaggaacuuacggggagagagcacugcucuccccaucacaccgcgauucggcaagcucuggucuguugggaugaacucacaaaacugaucgccuggaugagcuccaacauuaccucugagcagguucgcacaaucauugugaaucaugugaacgacaccuggggacugaaggucagacagagccucugguuccaccuguccugccuuacauuuggccagcauaccgugcaagaguuccugguuucuuuugggguguggauccggacgccugcccccuaucgcccucccaaugcuccuauccucagcacccugccggaacacacagucauuugu

SEQ ID NO: 2027 - RNA, 303 nt, Artificial Sequence
  derived and/or modified CDS sequence (opt5) from Japanese encephalitis virus__Cterm-JEV/JEV
ggcagcacccuggggaaggccuucuccacaacgcucaaaggagcucagagacuggccgcgcuuggcgacaccgcuugggauuuugggucuaucggaggcguguucaacagcauugggcgggccguccaccaaguuuuuggaggcgccuuccgcacacuguuuggcgggauguccuggaucacccagggacucaugggcgcucugcuucuguggaugggggugaaugccagagaccggucuauugcucucgccuuccuggcgacaggaggcgugcuggucuuucucgccaccaacgugcaugcu

SEQ ID NO: 2028 - RNA, 15 nt, Artificial Sequence
  derived and/or modified CDS sequence (opt5) from Artificial__MKRKK
augaagagaaagaaa

SEQ ID NO: 2029 - RNA, 9 nt, Artificial Sequence
  derived and/or modified CDS sequence (opt5) from Artificial__Linker(SGG)
agcggcggg

SEQ ID NO: 2030 - RNA, 27 nt, Artificial Sequence
  derived and/or modified CDS sequence (opt5) from Artificial__Linker(G4SG4)
ggcgggggaggcagcgggggaggcggg

SEQ ID NO: 2031 - RNA, 51 nt, Artificial Sequence
  derived and/or modified CDS sequence (opt5) from Foot-and-mouth disease virus__F2A/P2A
aacuucgaccugcucaagcuggccggcgauguggagagcaaucccgggccu

SEQ ID NO: 2032 - RNA, 300 nt, Artificial Sequence
  derived and/or modified CDS sequence (opt5) from DENV-1 CYD23__C
augaacaaucagagaaagaaaaccgcccggcccagcuucaacaugcugaagcgcgcuagaaaucggguguccacagucucucaacucgccaaacgcuuuagcaagggccugcuuuccgggcagggaccuaugaaacugguuauggcguucaucgcuuuucucagauuccuggccauuccgcccacggccggcauccuugcucggugggggucuuuuaagaagaacggagccauuaaagugcugcgcggcuucaagaaagagaucagcaauaugcucaacauuaugaauagacggcgcaag

SEQ ID NO: 2033 - RNA, 342 nt, Artificial Sequence
  derived and/or modified CDS sequence (opt5) from DENV-1 CYD23__C-SSc
augaacaaucagagaaagaaaaccgcccggcccagcuucaacaugcugaagcgcgcuagaaaucggguguccacagucucucaacucgccaaacgcuuuagcaagggccugcuuuccgggcagggaccuaugaaacugguuauggcguucaucgcuuuucucagauuccuggccauuccgcccacggccggcauccuugcucggugggggucuuuuaagaagaacggagccauuaaagugcugcgcggcuucaagaaagagaucagcaauaugcucaacauuaugaauagacggcgcaaguccgugaccaugcugcugaugcucaugccuacagcucuggcc

SEQ ID NO: 2034 - RNA, 273 nt, Artificial Sequence
  derived and/or modified CDS sequence (opt5) from DENV-1 CYD23__pr
uuccaccugaccacaagaggcggggagccccauaugaucgugagcaagcaggaacggggaaaaucccuccuguuuaagacgucugccggcgucaacaugugcacccuuauugcuauggaccugggggagcucugugaagauacaaugaccuacaaaugcccucgcaucacagaggccgaaccggacgauguugacuguuggugcaaugcgaccgauacaugggugaccuauggaacguguagccaaaccggcgagcacagacgggacaagcgc

SEQ ID NO: 2035 - RNA, 225 nt, Artificial Sequence
  derived and/or modified CDS sequence (opt5) from DENV-1 CYD23__M
agcguggcccuggcuccccacgucggccucgggcuggagaccagaacagaaacguggauguccucugagggagccuggaagcagauccaacggguugaaaccugggcgcuucgccauccuggcuucacagugauugcucuguuucucgcccacgccaucgggaccagcauuacacagaaaggaaucauuuucauccugcuuaugcuggugaccccguccauggcu

SEQ ID NO: 2036 - RNA, 498 nt, Artificial Sequence
  derived and/or modified CDS sequence (opt5) from DENV-1 CYD23__prM
uuccaccugaccacaagaggcggggagccccauaugaucgugagcaagcaggaacggggaaaaucccuccuguuuaagacgucugccggcgucaacaugugcacccuuauugcuauggaccugggggagcucugugaagauacaaugaccuacaaaugcccucgcaucacagaggccgaaccggacgauguugacuguuggugcaaugcgaccgauacaugggugaccuauggaacguguagccaaaccggcgagcacagacgggacaagcgcuccguggcucuggcuccccaugucgggcuuggacuggagacaagaaccgaaacauggaugucuagcgagggcgccuggaaacagauucagcggguggaaaccugggcccuccgccacccuggcuucacgguuaucgcccuguuucuggcucaugccauugggacauccaucacccagaagggaaucauuuucauccuccugaugcuugugacacccucuauggcg

SEQ ID NO: 2037 - RNA, 1485 nt, Artificial Sequence
  derived and/or modified CDS sequence (opt5) from DENV-1 CYD23__E
augagaugcgugggcaucgggagccgggacuucgucgagggacuguccggcgccaccuggguugauguggugcucgaacacgggucuugugucacaacgauggcuaaggacaaacccacccuggauauugagcuucugaagacagaagugaccaacccugccguucuccgcaaacugugcaucgaggcgaagauuagcaauacaaccacagacuccagauguccgacccagggagaagcuacgcuuguggaggagcaagaugccaacuuugucugccggcgcaccuucguggacagaggcugggggaauggauguggccuguuuggcaaagggucucucaucacaugcgccaaguucaaguguguuaccaaacuggaaggaaagauugugcaguacgagaaccugaaauauagcgucaucgugacagugcauaccggcgaucagcaccaggucgggaaugaauccacggagcauggaacaaccgcuacaaucacaccccaagccccuaccaccgagauucagcucacggacuacggcgcucugacccuugauugcucuccccggacagggcuggacuuuaacgaaaugguucuccugaccaugaaggagaaaagcuggcuugugcacaagcagugguuccuggaucucccucugcccuggacauccggagccagcaccucucaggaaacguggaaucgccaagaccugcucgugacauuuaagaccgcgcaugccaaaaagcaggaggucgugguucugggcucccaggaaggcgcuaugcacaccgcccuuacaggggcuaccgagauccagacaagcggaacgaccacaauuuucgccggccaccugaaauguagacucaagauggauaaacugacccuuaaggggaugucuuaugugaugugcacaggauccuuuaaacuggagaaggaagucgcggagacccaacauggcacggugcucguucagaucaaguacgaagggaccgacgccccuuguaaaauuccguucagcacacaggacgagaagggagugacccaaaacggccggcugaucacagcuaaucccauugucaccgauaaagaaaagccugugaacaucgaggccgagcccccuuuuggcgaaucuuauaucgucauuggggcuggagagaaagcccugaagcucuccugguucaagaaaggcagcuccaucgggaagauguuugaagccacggcucgcggagcgagacggauggccauucugggcgacacagcuugggauuucgggucuaucggcggaguguucaccagcguuggcaaacuugugcaccagauuuuugggacagccuacggaguccuguucuccggcgugagcuggaccaugaagaucgggaucggaguucuccugaccuggcuuggccucaauucucgcuccacaagccugucuaugacgugcauugccguggggcuggucacccuguaucucggcgugauggugcaggcu

SEQ ID NO: 2038 - RNA, 1983 nt, Artificial Sequence
  derived and/or modified CDS sequence (opt5) from DENV-1 CYD23__prME
uuccaccugaccacaagaggcggggagccccauaugaucgugagcaagcaggaacggggaaaaucccuccuguuuaagacgucugccggcgucaacaugugcacccuuauugcuauggaccugggggagcucugugaagauacaaugaccuacaaaugcccucgcaucacagaggccgaaccggacgauguugacuguuggugcaaugcgaccgauacaugggugaccuauggaacguguagccaaaccggcgagcacagacgggacaagcgcuccguggcucuggcuccccaugucgggcuuggacuggagacaagaaccgaaacauggaugucuagcgagggcgccuggaaacagauucagcggguggaaaccugggcccuccgccacccuggcuucacgguuaucgcccuguuucuggcucaugccauugggacauccaucacccagaagggaaucauuuucauccuccugaugcuugugacacccucuauggcgaugagaugcgucggcauugggagccgggauuuuguggagggacuguccggcgccaccuggguugacgugguccucgagcacgggagcugugugaccacaauggcuaaggauaaaccuacgcuggacaucgaacuucugaagaccgaggugacaaaccccgccguccuccgcaaacugugcauugaagcuaagaucucuaauaccacaaccgauuccagauguccuacgcaaggagaggccacacugguugaggaacaggacgcgaacuucgugugccggcgcaccuuuguggauagaggcuggggcaauggguguggacucuucggcaaagggagccugauuaccugcgccaaguuuaagugcgucacaaaacuugagggaaagaucgugcaguacgaaaaccugaaauauucuguuaucgugaccguccacacaggcgaccagcaucaaguggggaaugaguccacggaacacggaaccacagcuaccauuacaccgcaggcccccaccacggagauccagcucaccgacuacggcgcucugacacuugauuguagcccucggaccggccuggacuucaacgaaaugguucuccugacaaugaaggagaaaucuuggcuggugcauaagcagugguuucucgaucugccccuuccuuggaccuccggggccagcacgucccaagagacauggaaucgccaggaccugcucgucaccuucaaaacagcccacgcuaagaagcaggaaguggucgugcugggaucucaagagggcgcgaugcacaccgcccuuaccggggcuacagaaauucagacgagcggaaccacaaccaucuuugccggccaucugaaaugcagacucaagauggauaaacugacacugaaggggauguccuauguuauguguaccggcagcuucaaacucgagaaggaaguggccgagacgcagcacggaacaguccuggugcagauuaaguacgagggcaccgacgcucccugcaaaaucccguucucuacccaagaugaaaaggggguuacacagaacggacggcuuaucaccgccaauccuauugugacagacaaagagaagcccgucaacaucgaagcggagccucccuuuggcgaguccuauauugugaucggggcuggagaaaaagcccugaagcucagcugguucaagaaaggcucuagcauugggaagauguuugaggccacggcuagaggcgcccgccggauggcuauccugggagauaccgccugggacuucggcuccaucgggggaguguuuacaucuguuggcaaacugguccaucagauuuucgggaccgcguacggagugcuuuuuagcggcguguccuggacaaugaagaucgggauuggcguccuccugaccuggcugggacucaauagcagaucuacgucccugagcaugaccuguaucgccgugggccuuguuacacuguaccucggggugaugguccaggcu

SEQ ID NO: 2039 - RNA, 2025 nt, Artificial Sequence
  derived and/or modified CDS sequence (opt5) from DENV-1 CYD23__SSc-prME
agcgugaccaugcugcucaugcugaugcccacagcccuugcuuuccaccugacgaccagaggcggggagccccauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaggaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccucccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcu

SEQ ID NO: 2040 - RNA, 2325 nt, Artificial Sequence
  derived and/or modified CDS sequence (opt5) from DENV-1 CYD23__C-prME
augaacaaucagagaaagaaaaccgcccggcccagcuucaacaugcugaagcgcgcuagaaaucggguguccacagucucucaacucgccaaacgcuuuagcaagggccugcuuuccgggcagggaccuaugaaacugguuauggcguucaucgcuuuucucagauuccuggccauuccgcccacggccggcauccuugcucggugggggucuuuuaagaagaacggagccauuaaagugcugcgcggcuucaagaaagagaucagcaauaugcucaacauuaugaauagacggcgcaaguccgugaccaugcugcugaugcucaugccuacagcucuggccuuucaccuuaccacaagagggggagaaccccauaugaucgucucuaaacaggagcggggcaagagccuucucuucaagaccuccgcgggcgugaacaugugcacacugaucgccauggaccuuggggaacugugugaggauaccaugacguacaaaugcccucgcauuaccgaagcugagcccgacgauguugacuguuggugcaaugccacagauaccugggugacauauggaaccuguagccagacgggcgagcacagacgggacaagcgcucugucgcucucgccccucauguggggcugggacuggaaacaagaaccgagacauggauguccagcgaaggcgcguggaaacaaauccagcggguugagaccugggcccucagacacccgggguuuaccgugauugcucuguuccuugcccaugcuaucggaacaucuauuacgcagaagggcaucauuuuuauccugcucaugcuggucacccccuccauggccaugcgcugcgugggcaucgggagccgggauuucguggagggacuuucuggcgccacaugggucgacguugugcuggaacacggguccugugugaccacaauggcuaaagauaagccuacccucgacauugagcugcugaaaacggaagucacaaaccccgcggugcucagaaagcugugcaucgaggccaagauuagcaauaccaccacagauucccgcuguccuacccagggagaagcuacacuuguugaggagcaagacgccaacuuugugugccggagaacguucgucgaucgcggcugggggaauggauguggccuguucggcaaagggucucucauuaccugcgccaaguuuaaaugcgugacaaagcuggaaggaaaaaucguucaguacgagaaccuuaaguauagcgugaucgucaccgugcacacaggcgaccagcaucaggucgggaaugaauccaccgagcacggaacgaccgcuacaaucacaccccaagccccgaccaccgaaauucagcugacggacuacggcgcgcucacacuggauuguagcccucggaccgggcuggacuucaacgagauggugcuccugacaaugaaggagaaaucuuggcuuguucauaagcagugguuucuggaucucccccugccuuggaccuccggcgcuagcaccucucaagaaacauggaacagacaggaccugcuugugacguucaaaaccgcccacgccaagaaacaggaggucgugguucucggaagccaggaaggcgcuaugcacacagcccugaccggggcuacagagauccaaaccuccggaacgacaaccauuuuugccggccaucugaagugccgccucaagauggauaaacugacccuuaaggggaugucuuaugugauguguacaggcagcuucaaacuggaaaaggaggucgcggagacccagcacggaacagugcucgugcagaucaaauacgaagggacggacgcccccugcaagauucccuuuuccacccaggaugagaagggcguuacacaaaauggacggcugaucaccgcuaacccuaucgucacagacaaagaaaagccggugaauauugaggccgagcccccuuucggcgaaagcuauaucgugauuggggcuggagagaaagcccugaagcugucuugguuuaaaaagggcuccagcaucgggaaaauguucgaagcgaccgccagaggagcucgccggauggccauucucggcgauacggcuugggacuuugggucuaucggcggagucuucaccuccgugggcaagcugguucaucagauuuuugggacagccuacggagugcuguucagcggcgucuccuggaccaugaagaucgggaucggagugcuccugacauggcuuggccugaacucuagaagcaccucccucucuaugacauguauugccguugggcuggugacccuguaccuuggcgucauggugcaggcu

SEQ ID NO: 2041 - RNA, 45 nt, Artificial Sequence
  derived and/or modified CDS sequence (opt5) from DENV-1 CYD23__SSc
augagcgugaccaugcugcucaugcugaugcccacagcccuugcu

SEQ ID NO: 2042 - RNA, 57 nt, Artificial Sequence
  derived and/or modified CDS sequence (opt5) from DENV-1 CYD23__SSopt
augaagagaaagaaaagcgugaccaugcugcucaugcugaugcccacagcccuugcu

SEQ ID NO: 2043 - RNA, 57 nt, Artificial Sequence
  derived and/or modified CDS sequence (opt5) from DENV-1 CYD23__SSm
augacccagaagggcaucauuuucauccugcucaugcuggugacacccagcauggcc

SEQ ID NO: 2044 - RNA, 1488 nt, Artificial Sequence
  derived and/or modified CDS sequence (opt5) from DENV-1 CYD23__E
augagaugcgugggcaucgggagccgggacuucgucgagggacuguccggcgccaccuggguugauguggugcucgaacacgggucuugugucacaacgauggcuaaggacaaacccacccuggauauugagcuucugaagacagaagugaccaacccugccguucuccgcaaacugugcaucgaggcgaagauuagcaauacaaccacagacuccagauguccgacccagggagaagcuacgcuuguggaggagcaagaugccaacuuugucugccggcgcaccuucguggacagaggcugggggaauggauguggccuguuuggcaaagggucucucaucacaugcgccaaguucaaguguguuaccaaacuggaaggaaagauugugcaguacgagaaccugaaauauagcgucaucgugacagugcauaccggcgaucagcaccaggucgggaaugaauccacggagcauggaacaaccgcuacaaucacaccccaagccccuaccaccgagauucagcucacggacuacggcgcucugacccuugauugcucuccccggacagggcuggacuuuaacgaaaugguucuccugaccaugaaggagaaaagcuggcuugugcacaagcagugguuccuggaucucccucugcccuggacauccggagccagcaccucucaggaaacguggaaucgccaagaccugcucgugacauuuaagaccgcgcaugccaaaaagcaggaggucgugguucugggcucccaggaaggcgcuaugcacaccgcccuuacaggggcuaccgagauccagacaagcggaacgaccacaauuuucgccggccaccugaaauguagacucaagauggauaaacugacccuuaaggggaugucuuaugugaugugcacaggauccuuuaaacuggagaaggaagucgcggagacccaacauggcacggugcucguucagaucaaguacgaagggaccgacgccccuuguaaaauuccguucagcacacaggacgagaagggagugacccaaaacggccggcugaucacagcuaaucccauugucaccgauaaagaaaagccugugaacaucgaggccgagcccccuuuuggcgaaucuuauaucgucauuggggcuggagagaaagcccugaagcucuccugguucaagaaaggcagcuccaucgggaagauguuugaagccacggcucgcggagcgagacggauggccauucugggcgacacagcuugggauuucgggucuaucggcggaguguucaccagcguuggcaaacuugugcaccagauuuuugggacagccuacggaguccuguucuccggcgugagcuggaccaugaagaucgggaucggaguucuccugaccuggcuuggccucaauucucgcuccacaagccugucuaugacgugcauugccguggggcuggucacccuguaucucggcgugauggugcaggcuuga

SEQ ID NO: 2045 - RNA, 1182 nt, Artificial Sequence
  derived and/or modified CDS sequence (opt5) from DENV-1 CYD23__EdelTM-variant (aa1-394)
augagaugcgugggcaucgggagccgggacuucgucgagggacuguccggcgccaccuggguugauguggugcucgaacacgggucuugugucacaacgauggcuaaggacaaacccacccuggauauugagcuucugaagacagaagugaccaacccugccguucuccgcaaacugugcaucgaggcgaagauuagcaauacaaccacagacuccagauguccgacccagggagaagcuacgcuuguggaggagcaagaugccaacuuugucugccggcgcaccuucguggacagaggcugggggaauggauguggccuguuuggcaaagggucucucaucacaugcgccaaguucaaguguguuaccaaacuggaaggaaagauugugcaguacgagaaccugaaauauagcgucaucgugacagugcauaccggcgaucagcaccaggucgggaaugaauccacggagcauggaacaaccgcuacaaucacaccccaagccccuaccaccgagauucagcucacggacuacggcgcucugacccuugauugcucuccccggacagggcuggacuuuaacgaaaugguucuccugaccaugaaggagaaaagcuggcuugugcacaagcagugguuccuggaucucccucugcccuggacauccggagccagcaccucucaggaaacguggaaucgccaagaccugcucgugacauuuaagaccgcgcaugccaaaaagcaggaggucgugguucugggcucccaggaaggcgcuaugcacaccgcccuuacaggggcuaccgagauccagacaagcggaacgaccacaauuuucgccggccaccugaaauguagacucaagauggauaaacugacccuuaaggggaugucuuaugugaugugcacaggauccuuuaaacuggagaaggaagucgcggagacccaacauggcacggugcucguucagaucaaguacgaagggaccgacgccccuuguaaaauuccguucagcacacaggacgagaagggagugacccaaaacggccggcugaucacagcuaaucccauugucaccgauaaagaaaagccugugaacaucgaggccgagcccccuuuuggcgaaucuuauaucgucauuggggcuggagagaaagcccugaagcucuccugguucaagaaa

SEQ ID NO: 2046 - RNA, 1275 nt, Artificial Sequence
  derived and/or modified CDS sequence (opt5) from DENV-1 CYD23__EdelTM-variant (aa1-424)
augagaugcgugggcaucgggagccgggacuucgucgagggacuguccggcgccaccuggguugauguggugcucgaacacgggucuugugucacaacgauggcuaaggacaaacccacccuggauauugagcuucugaagacagaagugaccaacccugccguucuccgcaaacugugcaucgaggcgaagauuagcaauacaaccacagacuccagauguccgacccagggagaagcuacgcuuguggaggagcaagaugccaacuuugucugccggcgcaccuucguggacagaggcugggggaauggauguggccuguuuggcaaagggucucucaucacaugcgccaaguucaaguguguuaccaaacuggaaggaaagauugugcaguacgagaaccugaaauauagcgucaucgugacagugcauaccggcgaucagcaccaggucgggaaugaauccacggagcauggaacaaccgcuacaaucacaccccaagccccuaccaccgagauucagcucacggacuacggcgcucugacccuugauugcucuccccggacagggcuggacuuuaacgaaaugguucuccugaccaugaaggagaaaagcuggcuugugcacaagcagugguuccuggaucucccucugcccuggacauccggagccagcaccucucaggaaacguggaaucgccaagaccugcucgugacauuuaagaccgcgcaugccaaaaagcaggaggucgugguucugggcucccaggaaggcgcuaugcacaccgcccuuacaggggcuaccgagauccagacaagcggaacgaccacaauuuucgccggccaccugaaauguagacucaagauggauaaacugacccuuaaggggaugucuuaugugaugugcacaggauccuuuaaacuggagaaggaagucgcggagacccaacauggcacggugcucguucagaucaaguacgaagggaccgacgccccuuguaaaauuccguucagcacacaggacgagaagggagugacccaaaacggccggcugaucacagcuaaucccauugucaccgauaaagaaaagccugugaacaucgaggccgagcccccuuuuggcgaaucuuauaucgucauuggggcuggagagaaagcccugaagcucuccugguucaagaaaggcagcuccaucgggaagauguuugaagccacggcucgcggagcgagacggauggccauucugggcgacacagcuugggauuucgggucuuga

SEQ ID NO: 2047 - RNA, 1266 nt, Artificial Sequence
  derived and/or modified CDS sequence (opt5) from DENV-1 CYD23__EdelTM-variant (aa1-421)
augagaugcgugggcaucgggagccgggacuucgucgagggacuguccggcgccaccuggguugauguggugcucgaacacgggucuugugucacaacgauggcuaaggacaaacccacccuggauauugagcuucugaagacagaagugaccaacccugccguucuccgcaaacugugcaucgaggcgaagauuagcaauacaaccacagacuccagauguccgacccagggagaagcuacgcuuguggaggagcaagaugccaacuuugucugccggcgcaccuucguggacagaggcugggggaauggauguggccuguuuggcaaagggucucucaucacaugcgccaaguucaaguguguuaccaaacuggaaggaaagauugugcaguacgagaaccugaaauauagcgucaucgugacagugcauaccggcgaucagcaccaggucgggaaugaauccacggagcauggaacaaccgcuacaaucacaccccaagccccuaccaccgagauucagcucacggacuacggcgcucugacccuugauugcucuccccggacagggcuggacuuuaacgaaaugguucuccugaccaugaaggagaaaagcuggcuugugcacaagcagugguuccuggaucucccucugcccuggacauccggagccagcaccucucaggaaacguggaaucgccaagaccugcucgugacauuuaagaccgcgcaugccaaaaagcaggaggucgugguucugggcucccaggaaggcgcuaugcacaccgcccuuacaggggcuaccgagauccagacaagcggaacgaccacaauuuucgccggccaccugaaauguagacucaagauggauaaacugacccuuaaggggaugucuuaugugaugugcacaggauccuuuaaacuggagaaggaagucgcggagacccaacauggcacggugcucguucagaucaaguacgaagggaccgacgccccuuguaaaauuccguucagcacacaggacgagaagggagugacccaaaacggccggcugaucacagcuaaucccauugucaccgauaaagaaaagccugugaacaucgaggccgagcccccuuuuggcgaaucuuauaucgucauuggggcuggagagaaagcccugaagcucuccugguucaagaaaggcagcuccaucgggaagauguuugaagccacggcucgcggagcgagacggauggccauucugggcgacacagcuugggauuga

SEQ ID NO: 2048 - RNA, 2031 nt, Artificial Sequence
  derived and/or modified CDS sequence (opt5) from DENV-1 CYD23__SSc-prME
augagcgugaccaugcugcucaugcugaugcccacagcccuugcuuuccaccugacgaccagaggcggggagccccauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaggaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccucccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcuuga

SEQ ID NO: 2049 - RNA, 2031 nt, Artificial Sequence
  derived and/or modified CDS sequence (opt5) from DENV-1 CYD23__SSc-prME(F108S)
augagcgugaccaugcugcucaugcugaugcccacagcccuugcuuuccaccugacgaccagaggcggggagccccauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaggaacaggacgcuaacuucgugugccggcgcacauuugucgauagaggcuggggcaauggguguggacucucuggcaaagggucccugauuaccugcgccaaguucaagugcgugacaaaacuugagggaaagaucguucaguacgaaaaccugaaauauagcgugaucgucacggugcacaccggcgaccagcaucaaguugggaaugagucuacagaacacggaaccacagcuaccauuacgccccaggccccuaccacagagauccagcucaccgacuacggcgcccugacacuggauuguagcccccggaccggccucgacuuuaacgaaauggugcugcuuacgaugaaggagaaauccuggcugguccauaagcagugguuccucgaucugccucuucccuggacauccggggcuucuaccagccaagagacauggaaucgccaggaccugcucgugaccuuuaaaaccgcgcacgccaagaagcaggaagucgugguucugggaucccaagagggcgcuaugcacacagcccugacgggggccaccgaaauucagacaagcggaaccacaaccaucuucgcuggccaucucaaaugcagacugaagauggauaaacuuacgcugaaggggaugucuuaugugauguguacaggcuccuuuaaacucgagaaggaagucgccgagacccagcacggaaccgugcugguucagauuaaguacgagggcacagacgcgccgugcaaaaucccuuucagcacccaagaugaaaagggggugacacagaacggacggcugaucacggcuaaucccauugucaccgacaaagagaagccugugaacaucgaagccgagccucccuucggcgagucuuauauugugaucggggccggagaaaaagcucuuaagcucagcugguuuaagaaaggcuccucuauugggaagauguucgaggccacagcuagaggcgcccgccggauggcgauccugggagauaccgccugggacuuuggcagcaucgggggaguuuucacauccgucggcaaacuggugcaucagauuuuugggaccgcuuacggaguccucuucagcggcgugucuuggacgaugaagaucgggauuggcgugcugcuuaccuggcugggacucaauuccagaagcacaucucuguccaugaccuguaucgccguuggccuggugacacuuuaccucggggucauggugcaggcuuga

SEQ ID NO: 2050 - RNA, 2031 nt, Artificial Sequence
  derived and/or modified CDS sequence (opt5) from DENV-1 CYD23__SSc-prMEdelstem_TM-JEV
augagcgugaccaugcugcucaugcugaugcccacagcccuugcuuuccaccugacgaccagaggcggggagccccauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaggaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccucccuuuggcgagagcuauauugugaucggggccggagaaaaagcucuuaagcucucuugguucaagaaaggcagcacacuggggaaggccuuuuccaccacacugaaaggcgcucagagacucgccgcgcugggagauaccgccugggacuucggcucuauugggggaguuuuuaauagcaucggccgcgcuguccaucagguguucgggggagccuuucggacgcuuuucggcgggauguccuggaucacccaaggccugaugggagcucuccugcuguggaugggcgugaacgccagagaucgcagcauugcgcuugccuuucucgcuacagggggaguccugguguuccuggccaccaauguucacgcuuga

SEQ ID NO: 2051 - RNA, 2379 nt, Artificial Sequence
  derived and/or modified CDS sequence (opt5) from DENV-1 CYD23__C-P2A-SSc-prME
augaacaaucagagaaagaaaaccgcccggcccagcuucaacaugcugaagcgcgcuagaaaucggguguccacagucucucaacucgccaaacgcuuuagcaagggccugcuuuccgggcagggaccuaugaaacugguuauggcguucaucgcuuuucucagauuccuggccauuccgcccacggccggcauccuugcucggugggggucuuuuaagaagaacggagccauuaaagugcugcgcggcuucaagaaagagaucagcaauaugcucaacauuaugaauagacggcgcaagaacuuugaccugcugaaacucgcuggggauguggaauccaauccuggacccucugucaccaugcugcuuaugcugaugccuacagcccucgcguuccaccugaccacaagaggcggcgagccccauaugaucgugagcaagcaggaacgggggaagucccuucuguuuaaaaccagcgccggaguuaacaugugcacacucaucgcuauggaccugggcgagcugugugaagauaccaugacguacaagugcccucgcauuaccgaggccgagccggacgauguggacuguuggugcaaugcuacagauaccugggucacauaugggaccuguucucagacgggagaacacagacgggacaaacgcuccguggcccucgcgccccauguuggccuggggcuugagacaagaaccgaaacauggaugagcucugagggagccuggaagcaaauccagcggguggagaccugggcucugagacacccuggcuucaccgucauugcccucuuucuggcucaugccaucggcacauccauuacgcagaaagggaucauuuucauccuucugaugcucgugacccccagcauggccaugcgcugcgugggaaucggcucucgggauuuugucgaagggcuguccggagcuacauggguugacguggugcuggagcacggcagcugugucaccacaauggcgaaggauaaaccuacccucgacauugaacugcuuaagacggaggugacaaaccccgccguucugagaaagcucugcaucgaagcuaaaauuuccaauaccaccacagauucucgcuguccgacccagggggaggccacacugguggaggaacaagacgccaacuucgucugccggagaacguucguggaccgcggauggggcaauggcugugggcuuuuuggaaagggcagccugcuuaccugcgcuaaauucaagugcguuacaaaacuggaggggaagaucgugcaguacgaaaaccugaaguauuccgucauugugaccguccacacaggagaucagcaucaggugggcaacgagagcaccgaacacgggacgaccgccacaaucaccccucaagcgcccacaaccgagauccagcucacggacuacggcgcucugacacuugauuguucuccucggaccggacuggacuuuaaugagaugguucuccugacaaugaaagaaaaguccuggcuggugcauaaacagugguuccuugaucucccccugcccuggaccagcggcgccucuaccagccaagagacauggaacagacaggaccugcucgucacguuuaagaccgcccacgcuaaaaagcaggaagugguugugcuggggucccaggagggagccaugcacacagcucuuaccggcgccacagaaauucaaaccucugggacgacaaccaucuucgcgggacaucugaagugccgccucaaaauggauaagcugacccugaaaggcaugagcuaugucauguguacaggguccuuuaagcucgagaaagagguggccgaaacccagcacggcacagugcucguucagauuaaguacgagggaacggacgcuccuugcaagaucccguucagcacccaggaugaaaaaggcgucacacaaaaugggcggcugauuaccgccaaccccaucgugacagacaaggagaaaccugugaauaucgaggcugaacccccuuuuggagagucuuauauugucaucggcgccggggaaaaggcgcugaaacucuccugguucaagaaaggaagcucuauuggcaagauguuugaggccaccgcuagaggggcccgccggauggcuauccugggcgauacggccugggacuucggauccauuggcgggguguuuaccagcguuggaaaacuugugcaucagaucuucggcacagccuacgggguccuguucuccggagugucuuggaccaugaagauuggcaucgggguucuccugacauggcugggccuuaacagcagauccaccucucucagcaugacauguaucgcugugggacuggucacccuguaccucggcgugaugguucaggcguga

SEQ ID NO: 2052 - RNA, 2043 nt, Artificial Sequence
  derived and/or modified CDS sequence (opt5) from DENV-1 CYD23__SSopt-prME(F108S)
augaagcgcaaaaagagcgugaccaugcugcucaugcugaugcccacagcccuugcuuuccaccugacgacccggggcggggagccccauaugaucgucuccaaacaggaacgcggaaagucucuccuguuuaaaacaagcgccggcguuaacaugugcacccuuauugcgauggaccugggggagcucugugaagauacaaugaccuacaagugcccgagaaucacagaggcugaacccgacgauguggacuguuggugcaaugccaccgauacgugggugaccuauggaacauguucccaaaccggcgagcaccggcgcgacaagagaucugucgcccuggcuccucauguggggcugggacucgagacacggaccgaaacguggaugagcuccgagggcgccuggaaacagauucagcgcguugaaacaugggcucugagacaccccggcuucaccgugaucgcccuuuuucuggcgcaugccauugggacaucuaucacccagaagggaaucauuuucauccuccugaugcuugucaccccuagcauggcuaugcggugcgugggcauugggucccgcgauuuuguugagggacugagcggcgccacauggguggacgucgugcucgagcacgggucuugugugacgaccauggcuaaagauaagcccacacuggacaucgaacugcucaaaaccgaggucacaaacccugccguucugagaaagcucugcauugaagcgaagaucuccaauaccacgacagauagccgguguccgacccaaggagaggccacccugguggaggagcaggacgcuaacuucgugugccgcagaacauuugucgaucggggcuggggcaauggguguggacucucuggcaaagggucccugauuaccugcgccaaguucaaaugcgugacaaaacuugagggaaagaucguucaguacgaaaaccugaaguauagcgugaucgucacggugcacaccggcgaccagcaucaaguugggaaugagucuacagaacacggaaccacagcuaccauuacgccccaggccccuaccacagagauccagcucaccgacuacggcgcccugacacuggauuguucccccagaaccggccucgacuuuaacgaaauggugcugcuuacgaugaaagaaaagagcuggcugguccauaagcagugguuccucgaucugccucuucccuggacauccggggcuucuaccagccaagagacauggaauagacaggaccugcucgugaccuuuaaaaccgcgcacgccaagaaacaggaagucgugguucugggaucccaagagggcgcuaugcacacagcccugacgggggccaccgaaauucagacaagcggaaccacaaccaucuucgcuggccaucucaagugccggcugaaaauggauaaacuuacgcugaaggggaugucuuaugugauguguacaggcuccuuuaagcucgagaaggaagucgccgagacccagcacggaaccgugcugguucagauuaaauacgagggcacagacgcgccgugcaagaucccuuucagcacccaagaugaaaaaggggugacacagaacggaagacugaucacggcuaaucccauugucaccgacaaggagaagccugugaacaucgaagccgagccucccuucggcgagucuuauauugugaucggggccggagaaaaagcucuuaagcucagcugguuuaaaaagggcuccucuauugggaaaauguucgaggccacagcucgcggcgcccggagaauggcgauccugggagauaccgccugggacuuuggcagcaucgggggaguuuucacauccgucggcaagcuggugcaucagauuuuugggaccgcuuacggagugcuuuucagcggcgucucuuggacgaugaagaucgggauuggcgugcugcuuaccuggcugggacucaauucccgcagcacaucucuguccaugaccuguaucgccguuggccuggugacacuuuaccucggggucauggugcaggcuuga

SEQ ID NO: 2053 - RNA, 2043 nt, Artificial Sequence
  derived and/or modified CDS sequence (opt5) from DENV-1 CYD23__SSopt-prME(F96H)
augaagcggaaaaagagcgugaccaugcugcucaugcugaugcccacagcccuugcuuuccaccugacgaccagaggcggggagccccauaugaucgucuccaaacaggaacgcggaaagucucuccuguuuaaaacaagcgccggcguuaacaugugcacccuuauugcgauggaccugggggagcucugugaagauacaaugaccuacaagugcccgagaaucacagaggcugaacccgacgauguggacuguuggugcaaugccaccgauacgugggugaccuauggaacauguucccaaaccggcgagcaccggcgcgacaagagaucugucgcccuggcuccucauguggggcugggacucgagacacggaccgaaacguggaugagcuccgagggcgccuggaaacagauucagcgcguugaaacaugggcucugagacaccccggcuucaccgugaucgcccuuuuucuggcgcaugccauugggacaucuaucacccagaagggaaucauuuucauccuccugaugcuugucaccccuagcauggcuaugcggugcgugggcauugggucccgcgauuuuguugagggacugagcggcgccacauggguggacgucgugcucgagcacgggucuugugugacgaccauggcuaaagauaagcccacacuggacaucgaacugcucaaaaccgaggucacaaacccugccguucugagaaagcucugcauugaagcgaagaucuccaauaccacgacagauagccgguguccgacccaaggagaggccacccugguggaggaacaggacgcuaacuucgugugccgcagaacacacgucgaucggggcuggggcaauggguguggacucuuuggcaaagggucucugauuaccugcgccaaguucaaaugcgugacaaaacuugagggaaagaucguucaguacgaaaaccugaaguauuccgugaucgucacggugcauaccggcgaccagcaccaaguugggaaugagagcacagaacauggaaccacagcuaccauuacgccccaggccccuaccacagagauccagcucaccgacuacggcgcccugacacuggauuguucuccccgcaccggccucgacuuuaacgaaauggugcugcuuacgaugaaagagaaguccuggcugguccacaagcagugguuccucgaucugccucuucccuggacaagcggggcuuccaccucucaagagacauggaauagacaggaccugcucgugaccuuuaaaaccgcgcacgccaagaaacaggaagucgugguucugggaagccaagagggcgcuaugcauacagcccugacgggggccaccgaaauucagacauccggaaccacaaccaucuucgcuggccaccucaagugccggcugaaaauggauaaacuuacgcugaaggggaugagcuaugugauguguacaggcucuuuuaagcucgagaaggaagucgccgagacccagcauggaaccgugcugguucagauuaaauacgagggcacagacgcgccgugcaagaucccuuucuccacccaagaugaaaaaggggugacacagaacggaagacugaucacggcuaaucccauugucaccgacaaggagaagccugugaacaucgaagccgagccucccuucggcgagagcuauauugugaucggggccggagaaaaagcucuuaagcucucuugguuuaaaaagggcagcuccauugggaaaauguucgaggccacagcucgcggcgcccggagaauggcgauccugggagauaccgccugggacuuuggcucuaucgggggaguuuucacaagcgucggcaagcuggugcaccagauuuuugggaccgcuuacggagugcuuuucuccggcgucagcuggacgaugaagaucgggauuggcgugcugcuuaccuggcugggacucaauucucgcuccacaagccugucuaugaccuguaucgccguuggccuggugacacuuuaccucggggucauggugcaggcuuga

SEQ ID NO: 2054 - RNA, 2043 nt, Artificial Sequence
  derived and/or modified CDS sequence (opt5) from DENV-1 CYD23__SSopt-prME(S186F)
augaagcggaaaaagagcgugaccaugcugcucaugcugaugcccacagcccuugcuuuccaccugacgaccagaggcggggagccccauaugaucgucuccaaacaggaacgcggaaagucucuccuguuuaaaacaagcgccggcguuaacaugugcacccuuauugcgauggaccugggggagcucugugaagauacaaugaccuacaagugcccgagaaucacagaggcugaacccgacgauguggacuguuggugcaaugccaccgauacgugggugaccuauggaacauguucccaaaccggcgagcaccggcgcgacaagagaucugucgcccuggcuccucauguggggcugggacucgagacacggaccgaaacguggaugagcuccgagggcgccuggaaacagauucagcgcguugaaacaugggcucugagacaccccggcuucaccgugaucgcccuuuuucuggcgcaugccauugggacaucuaucacccagaagggaaucauuuucauccuccugaugcuugucaccccuagcauggcuaugcggugcgugggcauugggucccgcgauuuuguugagggacugagcggcgccacauggguggacgucgugcucgagcacgggucuugugugacgaccauggcuaaagauaagcccacacuggacaucgaacugcucaaaaccgaggucacaaacccugccguucugagaaagcucugcauugaagcgaagaucuccaauaccacgacagauagccgguguccgacccaaggagaggccacccugguggaggaacaggacgcuaacuucgugugccgcagaacauuugucgaucggggcuggggcaauggguguggacucuucggcaaagggucucugauuaccugcgccaaguuuaaaugcgugacaaaacuugagggaaagaucguucaguacgaaaaccugaaguauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguuucccccgcaccggccucgacuuuaacgaaauggugcugcuuacgaugaaagagaagucuuggcugguccauaagcagugguuccucgaucugccucuucccuggacauccggggcuagcaccucccaagagacauggaauagacaggaccugcucgugaccuuuaaaaccgcgcacgccaagaaacaggaagucgugguucugggaucucaagagggcgcuaugcacacagcccugacgggggccaccgaaauucagacaagcggaaccacaaccaucuucgcuggccaucucaagugccggcugaaaauggauaaacuuacgcugaaggggauguccuaugugauguguacaggcagcuucaagcucgagaaggaagucgccgagacccagcacggaaccgugcugguucagauuaaauacgagggcacagacgcgccgugcaagaucccuuuuucuacccaagaugaaaaaggggugacacagaacggaagacugaucacggcuaaucccauugucaccgacaaggagaagccugugaacaucgaagccgagccucccuucggcgaguccuauauugugaucggggccggagaaaaagcucuuaagcucagcugguuuaaaaagggcucuagcauugggaaaauguucgaggccacagcucgcggcgcccggagaauggcgauccugggagauaccgccugggacuuuggcuccaucgggggaguuuucacaucugucggcaagcuggugcaucagauuuuugggaccgcuuacggagugcuuuucagcggcgucuccuggacgaugaagaucgggauuggcgugcugcuuaccuggcugggacucaauagccgcucuacaucccugagcaugaccuguaucgccguuggccuggugacacuuuaccucggggucauggugcaggcuuga

SEQ ID NO: 2055 - RNA, 2043 nt, Artificial Sequence
  derived and/or modified CDS sequence (opt5) from DENV-1 CYD23__SSopt-prME(R188L)
augaagcggaaaaagagcgugaccaugcugcucaugcugaugcccacagcccuugcuuuccaccugacgaccagaggcggggagccccauaugaucgucuccaaacaggaacgcggaaagucucuccuguuuaaaacaagcgccggcguuaacaugugcacccuuauugcgauggaccugggggagcucugugaagauacaaugaccuacaagugcccgagaaucacagaggcugaacccgacgauguggacuguuggugcaaugccaccgauacgugggugaccuauggaacauguucccaaaccggcgagcaccggcgcgacaagagaucugucgcccuggcuccucauguggggcugggacucgagacacggaccgaaacguggaugagcuccgagggcgccuggaaacagauucagcgcguugaaacaugggcucugagacaccccggcuucaccgugaucgcccuuuuucuggcgcaugccauugggacaucuaucacccagaagggaaucauuuucauccuccugaugcuugucaccccuagcauggcuaugcggugcgugggcauugggucccgcgauuuuguugagggacugagcggcgccacauggguggacgucgugcucgagcacgggucuugugugacgaccauggcuaaagauaagcccacacuggacaucgaacugcucaaaaccgaggucacaaacccugccguucugagaaagcugugcauugaagcgaagaucuccaauaccacgacagauagccgguguccgacccaaggagaggccacccugguggaggaacaggacgcuaacuucgugugccgcagaacauuugucgaucggggcuggggcaauggguguggacucuucggcaaagggucucugauuaccugcgccaaguuuaaaugcgugacaaaacuugagggaaagaucguucaguacgaaaaccugaaguauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccucaccggccuggacuucaacgaaauggugcuucugacgaugaaagagaaguccuggcucguccauaagcagugguuucuggaucuuccucugcccuggacaagcggggcuuccaccucucaagagacauggaaucgccaggaccuccuggugaccuucaaaaccgcgcacgccaagaaacaggaagucgugguucugggaagccaagagggcgcuaugcacacagcccucacgggggccaccgaaauucagacauccggaaccacaaccaucuuugcuggccaucugaagugcagacuuaaaauggauaagcugacgcucaaggggaugagcuaugugauguguacaggcucuuucaaacuggagaaggaagucgccgagacccagcacggaaccgugcugguucagauuaaauacgagggcacagacgcgccgugcaagaucccuuucuccacccaagaugaaaaaggggugacacagaacggacggcuuaucacggcuaaucccauugucaccgacaaggagaagccugugaacaucgaagccgagccucccuuuggcgagagcuauauugugaucggggccggagaaaaagcucucaagcugucuugguucaaaaagggcagcuccauugggaaaauguuugaggccacagcuagaggcgcccgccggauggcgauccugggagauaccgccugggacuucggcucuaucgggggaguuuuuacaagcgucggcaagcucgugcaucagauuuucgggaccgcuuacggagugcuguuuuccggcgucagcuggacgaugaagaucgggauuggcgugcuucugaccuggcucggacuuaauucuagauccacaagccugucuaugaccuguaucgccguuggccuugugacacucuaccugggggucauggugcaggcuuga

SEQ ID NO: 2056 - RNA, 2043 nt, Artificial Sequence
  derived and/or modified CDS sequence (opt5) from DENV-1 CYD23__SSopt-pr(D104A)MEdelstem_TM,(F108S)-JEV
augaagcgcaaaaagagcgugaccaugcugcucaugcugaugcccacagcccuugcuuuccaccugacgacccggggcggggagccccauaugaucgucuccaaacaggaacgcggaaagucucuccuguuuaaaacaagcgccggcguuaacaugugcacccuuauugcgauggaccugggggagcucugugaagauacaaugaccuacaagugcccgagaaucacagaggcugaacccgacgauguggacuguuggugcaaugccaccgauacgugggugaccuauggaacauguucccaaaccggcgagcaccggcgcgccaagagaucugucgcucuggccccucauguggggcugggacucgagacacggaccgaaacguggaugagcuccgagggcgcuuggaaacagauucagcgcguugaaacaugggcccugagacaccccggcuucaccgugaucgcgcuuuuucuggcccaugcuauugggacaucuaucacccagaagggaaucauuuucauccuccugaugcuugucaccccuagcauggccaugcggugcgugggcauugggucccgcgacuuuguugagggacugagcggcgcuacauggguggaugucgugcucgagcacgggucuugugugacgaccauggccaaagacaagcccacacuggauaucgaacugcucaaaaccgaggucacaaacccugcgguucugagaaaacuuugcauugaagccaagaucuccaauaccacgacagacagccgguguccgacccaaggagaggcuacccugguggaggagcaggaugccaacuucgugugccgcagaacauuugucgaccggggcuggggcaauggguguggacucucuggcaaagggucccugauuaccugcgcuaaguucaaaugcgugacaaaacuugagggaaagaucguucaguacgaaaaccugaaguauagcgugaucgucacggugcacaccggcgaucagcaucaaguugggaaugagucuacagaacacggaaccacagccaccauuacgccccaggccccuaccacagagauccagcucaccgacuacggcgcucugacacuggacuguucccccagaaccggccucgauuuuaacgaaauggugcugcuuacgaugaaagaaaagagcuggcugguccauaagcagugguuccucgaccugccucuucccuggacauccggggcgucuaccagccaagagacauggaauagacaggaucugcucgugaccuuuaaaaccgcccacgcuaagaaacaggaagucgugguucugggaucccaagagggcgccaugcacacagcccugacgggggcuaccgaaauucagacaagcggaaccacaaccaucuucgccggccaucucaagugccggcugaaaauggacaaacuuacgcugaaggggaugucuuaugugauguguacaggcuccuuuaagcucgagaaggaagucgcggagacccagcacggaaccgugcugguucagauuaaauacgagggcacagaugcuccgugcaagaucccuuucagcacccaagacgaaaaaggggugacacagaacggaagacugaucacggccaaucccauugucaccgauaaggagaagccugugaacaucgaagccgagccucccuucggcgagucuuauauugugaucggggcuggagaaaaagcccuuaagcucagcugguuuaaaaagggcuccacacuggggaaggcuuucucuaccacacugaagggcgcccagcgccucgcggcccugggagacaccgcuugggauuuuggcagcauugggggaguuuucaauuccaucggccgggccguccaucagguguuugggggagcuuucagaacgcuuuuuggcgggaugagcuggaucacccaaggccugaugggagcccuccugcuguggaugggcgugaacgcgcgcgaccggucuauugcccuugcuuuccucgccacagggggaguccugguguuucuggcuaccaauguucacgccuga

SEQ ID NO: 2057 - RNA, 2043 nt, Artificial Sequence
  derived and/or modified CDS sequence (opt5) from DENV-1 CYD23__SSopt-prMEdelstem_TM,(H261N)-JEV
augaagcggaaaaagagcgugaccaugcugcucaugcugaugcccacagcccuugcuuuccaccugacgaccagaggcggggagccccauaugaucgucuccaaacaggaacgcggaaagucucuccuguuuaaaacaagcgccggcguuaacaugugcacccuuauugcgauggaccugggggagcucugugaagauacaaugaccuacaagugcccgagaaucacagaggcugaacccgacgauguggacuguuggugcaaugccaccgauacgugggugaccuauggaacauguucccaaaccggcgagcaccggcgcgacaagagaucugucgcccuggcuccucauguggggcugggacucgagacacggaccgaaacguggaugagcuccgagggcgccuggaaacagauucagcgcguugaaacaugggcucugagacaccccggcuucaccgugaucgcccuuuuucuggcgcaugccauugggacaucuaucacccagaagggaaucauuuucauccuccugaugcuugucaccccuagcauggcuaugcggugcgugggcauugggucccgcgauuuuguugagggacugagcggcgccacauggguggacgucgugcucgagcacgggucuugugugacgaccauggcuaaagauaagcccacacuggacaucgaacugcucaaaaccgaggucacaaacccugccguucugagaaaacuuugcauugaagcgaagaucuccaauaccacgacagauagccgguguccgacccaaggagaggccacccugguggaggaacaggacgcuaacuucgugugccgcagaacauuugucgaucggggcuggggcaauggguguggacucuucggcaaggggucucugauuaccugcgccaaguuuaaaugcgugacaaaacuugagggaaagaucguucaguacgaaaaccugaaguauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccgcaccggccucgacuucaacgaaauggugcugcuuacgaugaaagagaaguccuggcugguccauaagcagugguuucucgaucugccucuucccuggacaagcggggcuuccaccucucaagagacauggaauagacaggaccugcucgugaccuucaaaaccgcgcacgccaagaaacaggaagucgugguucugggaagccaagagggcgcuaugaacacagcccugacgggggccaccgaaauucagacauccggaaccacaaccaucuuugcuggccaccucaagugccggcugaaaauggauaaacuuacgcugaaggggaugagcuaugugauguguacaggcucuuucaagcucgagaaggaagucgccgagacccagcauggaaccgugcugguucagauuaaauacgagggcacagacgcgccgugcaagaucccuuucuccacccaagaugaaaaaggggugacacagaauggaagacugaucacggcuaaccccauugucaccgacaaggagaagccugugaauaucgaagccgagccucccuuuggcgagagcuauauugugaucggggccggagaaaaagcucuuaagcucucuugguucaaaaagggcagcacacuggggaaagccuuuuccaccacacugaagggcgcucagcgccucgccgcgcugggagauaccgccugggacuucggcucuauugggggaguuuuuaacagcaucggccgggcuguccaccagguguucgggggagccuuuagaacgcuuuucggcgggauguccuggaucacccaaggccugaugggagcucuccugcuguggaugggcgugaaugcccgcgaucggagcauugcgcuugccuuucucgcuacagggggaguccugguguuccuggccaccaacguucaugcuuga

SEQ ID NO: 2058 - RNA, 2043 nt, Artificial Sequence
  derived and/or modified CDS sequence (opt5) from DENV-1 CYD23__SSopt-prMEdelstem_TM,(R188L,A267T)-JEV
augaagcggaaaaagagcgugaccaugcugcucaugcugaugcccacagcccuugcuuuccaccugacgaccagaggcggggagccccauaugaucgucuccaaacaggaacgcggaaagucucuccuguuuaaaacaagcgccggcguuaacaugugcacccuuauugcgauggaccugggggagcucugugaagauacaaugaccuacaagugcccgagaaucacagaggcugaacccgacgauguggacuguuggugcaaugccaccgauacgugggugaccuauggaacauguucccaaaccggcgagcaccggcgcgacaagagaucugucgcccuggcuccucauguggggcugggacucgagacacggaccgaaacguggaugagcuccgagggcgccuggaaacagauucagcgcguugaaacaugggcucugagacaccccggcuucaccgugaucgcccuuuuucuggcgcaugccauugggacaucuaucacccagaagggaaucauuuucauccuccugaugcuugucaccccuagcauggcuaugcggugcgugggcauugggucccgcgauuuuguugagggacugagcggcgccacauggguggacgucgugcucgagcacgggucuugugugacgaccauggcuaaagauaagcccacacuggacaucgaacugcucaaaaccgaggucacaaacccugccguucugagaaaacuuugcauugaagcgaagaucuccaauaccacgacagauagccgguguccgacccaaggagaggccacccugguggaggaacaggacgcuaacuucgugugccgcagaacauuugucgaucggggcuggggcaauggguguggacucuucggcaaagggucucugauuaccugcgccaaguuuaaaugcgugacaaaacuugagggaaagaucguucaguacgaaaaccugaaguauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccucaccggccuggacuucaacgaaauggugcuucugacgaugaaagagaaguccuggcucguccauaagcagugguuucuggaucuuccucugcccuggacaagcggggcuuccaccucucaagagacauggaaucgccaggaccuccuggugaccuucaaaaccgcgcacgccaagaaacaggaagucgugguucugggaagccaagagggcgcuaugcacacagcccucacggggaccacagaaauucagaccuccggaacaaccacgaucuuugccggccaucugaagugcagacuuaaaauggauaagcugacacucaaggggaugagcuaugugauguguaccggcucuuucaaacuggagaaggaagucgcugagacccagcacggaacagugcugguucagauuaaauacgagggcaccgacgccccgugcaagaucccuuucuccacacaagaugaaaaaggggugacgcagaacggacggcuuaucaccgcgaaucccauugucacagacaaggagaagccugugaacaucgaagcugagccucccuuuggcgagagcuauauugugaucggggccggagaaaaagcccucaagcugucuugguucaaaaagggcagcacccuggggaaggcuuuuuccacaacccucaagggcgcccagagacuggcugcccuuggagauacggcgugggacuucggcucuauugggggaguuuuuaauagcaucggccgcgccguccaucagguguucgggggagcuuuucggacccuguucggcgggauguccuggaucacacaaggccucaugggagcccugcugcuuuggaugggcgugaacgcuagagaucgcagcauugcccucgcguuucuggccaccgggggaguccugguguuccucgcuacaaauguucacgccuga

SEQ ID NO: 2059 - RNA, 300 nt, Artificial Sequence
  derived and/or modified CDS sequence (opt5) from DENV-2 CYD2-T__C
augaacaaucagagaaagaaagccaagaacacccccuucaauaugcugaaacgggagcgcaacagagugagcacaguccaacagcucacgaagcgguuuucccugggcaugcuucaggggcgcggaccucugaaacucuucauggcucugguugccuuucuuagauuccugaccaucccgcccacagcgggcauucucaagcggugggggaccaucaagaaaucuaaggcuauuaaugugcugcgcggauuuagaaaagaaaucggccggaugcugaacauucucaaucgcagacggcgc

SEQ ID NO: 2060 - RNA, 342 nt, Artificial Sequence
  derived and/or modified CDS sequence (opt5) from DENV-2 CYD2-T__C-SSc
augaacaaucagagaaagaaagccaagaacacccccuucaauaugcugaaacgggagcgcaacagagugagcacaguccaacagcucacgaagcgguuuucccugggcaugcuucaggggcgcggaccucugaaacucuucauggcucugguugccuuucuuagauuccugaccaucccgcccacagcgggcauucucaagcggugggggaccaucaagaaaucuaaggcuauuaaugugcugcgcggauuuagaaaagaaaucggccggaugcugaacauucucaaucgcagacggcgcagcgccgggaugaucaucaugcugauuccuacagugauggcc

SEQ ID NO: 2061 - RNA, 273 nt, Artificial Sequence
  derived and/or modified CDS sequence (opt5) from DENV-2 CYD2-T__pr
uuccaccugaccacaagaaacggcgagccccauaugaucgugagccggcaggaaaaggggaaaucccuccuguuuaagacggaggacggagucaauaugugcacccuuauggccauggaucugggcgaacucugugaggacacaauuaccuacaaaugcccucugcuucgccaaaacgaaccggaggauaucgacuguuggugcaauucuacaagcaccuggguuacauaugggaccuguacgaccaugggagagcacagacgggaaaagcgc

SEQ ID NO: 2062 - RNA, 225 nt, Artificial Sequence
  derived and/or modified CDS sequence (opt5) from DENV-2 CYD2-T__M
agcguggcccuggucccccacguuggcauggggcucgagaccagaacagaaacguggauguccucugagggagcuuggaagcaugugcagcggaucgaaaccuggauucugcgccacccuggcuucacaaugauggccgcgauccuugcuuacaccauugggacaacccauuuucaaagagcccugaucuucauucuccugacagccgugaccccgagcaugacg

SEQ ID NO: 2063 - RNA, 498 nt, Artificial Sequence
  derived and/or modified CDS sequence (opt5) from DENV-2 CYD2-T__prM
uuccaccugaccacaagaaacggcgagccccauaugaucgugagccggcaggaaaaggggaaaucccuccuguuuaagacggaggacggagucaauaugugcacccuuauggccauggaucugggcgaacucugugaggacacaauuaccuacaaaugcccucugcuucgccaaaacgaaccggaggauaucgacuguuggugcaauucuacaagcaccuggguuacauaugggaccuguacgaccaugggagagcacagacgggaaaagcgcuccguggcucuggugccccaugucggcauggggcucgagacaagaaccgaaacauggaugucuagcgagggagccuggaaacacgugcagcggauugagaccuggauccugcgccauccuggcuucacgaugauggcggcuauucuggccuacacaaucggcaccacacacuuucagagagcccucaucuucauucugcuuaccgcuguuacccccuccaugaca

SEQ ID NO: 2064 - RNA, 1485 nt, Artificial Sequence
  derived and/or modified CDS sequence (opt5) from DENV-2 CYD2-T__E
augagaugcaucggcaugagcaaccgggacuucguggagggggucuccggaggcucuuggguugauauugugcuggaacacgggagcugugugaccacaauggccaagaauaaacccacgcucgacuuugagcugaucaagaccgaagcuaaacagccugccacacuucgcaaguacugcauugaggcgaaacugaccaacacaaccacagaauccagauguccgacccaaggagagcccucucucaaugaggaacaggauaagcgguucgucugcaagcauagcaugguggaccgcggcugggggaacggauguggccuguuuggcaaagggggaaucguuacgugcgcuauguucagauguaagaaaaauauggagggcaaggugguccagccugaaaaccuugaguauaccauugugaucacaccccacuccggggaggaacaugccguuggaaaugauaccggcaaacacgggaaggagaucaagauuacaccucagucuagcaucaccgaagccgagcugacgggauacggcacagugaccauggaaugcagcccccggacaggccucgacuuuaacgagaugguccugcugcaaauggagaauaaggcuuggcucgugcaucgccagugguuccuggaucuuccucugccguggcuccccggggccgacacccagggauccaacuggauucagaaagaaacccuggugacauuuaaaaauccucacgcuaagaaacaagaugucguugugcuuggcucucaggagggggccaugcacacggcgcugaccggagccacagaaauccagauguccagcggcaaccuccuguucaccgggcaucugaaguguagacuccggauggacaaacugcagcuuaagggaaugucuuauuccaugugcacaggcaaguuuaaaguggucaaggagauugcugaaacccaacacggcacgaucgugauucgcguucaguacgagggggauggaagccccuguaaaaucccuuucgagaucauggaccuggaaaagagacaugugcucggccggcugauuacagucaaucccaucgugaccgagaaagauucuccgguuaacauugaagccgagccucccuuuggggacuccuauaucauuaucggaguggaaccuggccagcuuaagcugaauugguucaagaaagggagcuccaucggccaaauguuugagaccacaaugcgcggagcuaagagaauggccauucucggcgacaccgcgugggauuucgggucucugggaggcgucuucacaagcaucgggaaagcccugcaccagguguuuggagcuauuuacggcgccgcuuucuccggggucagcuggacgaugaagauccucauuggcgugaucaucaccuggauuggaaugaacucucgguccacaagccugucuguuacccuugugcuggucggcaucgugacacucuaucuggggguuauggugcaggcc

SEQ ID NO: 2065 - RNA, 1983 nt, Artificial Sequence
  derived and/or modified CDS sequence (opt5) from DENV-2 CYD2-T__prME
uuccaccugaccacaagaaauggcgagccccauaugaucgugagccggcaggaaaaggggaaaucccuccuguuuaagacggaggacggagucaauaugugcacccuuauggccauggaucugggcgaacucugugaggacacaauuaccuacaaaugcccucugcuucgccaaaacgaaccggaggauaucgacuguuggugcaauucuacaagcaccuggguuacauaugggaccuguacgaccaugggagagcacagacgggaaaagcgcuccguggcucuggugccccaugucggcauggggcucgagacaagaaccgaaacauggaugucuagcgagggagccuggaaacacgugcagcggauugagaccuggauccugcgccauccuggcuucacgaugauggcggcuauucuggccuacacaaucggcaccacacacuuucagagagcccucaucuucauucugcuuaccgcuguuacccccuccaugacaaugcggugcaucgggaugucuaaccgcgauuuuguggaaggagucagcggcggguccuggguggacauuguucuggagcacggaagcugugugacgaccauggccaagaauaagccuacacucgauuucgaacugaucaaaaccgaggcuaagcagcccgccacacuuagaaaauauugcauugaagcgaagcugaccaacacgacaaccgagucucgguguccuacccaaggcgagccgucccucaaugaggaacaggacaaacgcuuugucugcaagcauagcaugguggauagaggguggggaaacggcuguggccuguucgggaagggaggcaucgugacaugcgccauguuucggugcaaaaagaauauggaagggaaagucguucagcccgagaaccuggaauacaccauugugaucacaccucacucuggagaggagcaugcugugggcaaugacacggggaagcacggaaaagaaaucaagauuacaccccaguccagcaucaccgaggccgaacucaccggcuauggcacagucaccauggaguguucuccucgcacggggcuggauuucaacgaaauggugcuucugcaaauggagaauaaggcuuggcucguucacagacagugguuucuggaccuuccccugccguggcucccuggagccgauacccagggcuccaacuggauucagaaagagacacuggugaccuucaagaauccccaugcgaaaaagcaagacgucgugguucuggggagccaggaaggagccaugcacacagcucucaccggcgccacggagauccagauguccucugggaaccugcuuuuuacaggccaucugaaaugccggcucagaauggacaagcugcaacuuaaaggaaugagcuacuccauguguaccggcaaguucaagguggucaaagaaauugcugagacacagcacgggaccaucgugauccgcguccaguaugagggagauggcagcccuugcaagauucccuucgaaaucauggaccuggagaaacggcaugugcucgggagacugauuaccguuaaccccaucgugacagaaaaggauucuccugucaauauugaggccgaaccgcccuuuggagacuccuacaucaucauuggcguggagccugggcagcugaaacucaacugguucaagaagggcagcucuaucggacaaauguuugagacgaccaugcgcggcgccaaacggauggcuauucugggggauacagcgugggacuucggaagccuuggcgggguuuuuaccuccaucggaaaggcccugcaccagguguucggcgcuauuuacggggccgccuuuucuggcgucagcuggacaaugaaaauccucauuggagugaucaucaccuggauuggcaugaacuccagaagcacgucucuguccgugacacugguucuugucgggaucgugacccucuaucugggagugaugguccaggcu

SEQ ID NO: 2066 - RNA, 2025 nt, Artificial Sequence
  derived and/or modified CDS sequence (opt5) from DENV-2 CYD2-T__SSc-prME
agcgccggcaugaucauuaugcugauccccaccgugauggcuuuccaccucacaacgagaaacggggagccucauaugauugucucccggcaggaaaagggaaaaucucugcuuuuuaagaccgaggacggcguuaauaugugcacacugauggccauggaucucggggaacugugugaggacaccaucacauacaaaugcccgcuucugcgccaaaacgaacccgaggauauugacuguuggugcaauagcaccuccacaugggugaccuauggaacguguaccacaaugggcgagcacagacgggaaaagcgcucuguggcgcucgucccucauguggggaugggacuggagaccagaacagaaaccuggaugagcuccgagggcgcuuggaaacacguucagcggaucgagacguggauccugcgccaucccggcuucacaaugauggccgccauucucgcuuacaccaucgggacaacccacuuucagagagcccugauuuucauccuucugaccgcugugacaccuucuaugacgaugcggugcauuggaaugagcaaccgcgauuuugucgaaggcguguccgggggaagcuggguugacaucgugcucgagcacggcucuugugucaccacaauggccaagaauaagcccacccuggauuucgaacuuauuaaaacagaggcgaagcagccugccacccugagaaaauauugcaucgaagcuaagcucacgaacacaaccaccgagucccgguguccgacacaaggggagcccagccugaaugaggaacaggacaaacgcuuugugugcaagcauucuaugguggauagaggauggggcaacggcugugggcuguucggaaagggcgggaucguuaccugcgccauguuucggugcaaaaagaauauggaaggaaaagucgugcagccugagaaccucgaauacacaauugugaucacgccccacuccggcgaggagcaugcugucgggaaugacaccggaaagcacggcaaagaaauuaagaucacaccucagagcucuauuaccgaggccgaacugacaggcuaugggaccgugacgauggaguguagcccccgcaccggacuugauuucaacgaaaugguucugcuccaaauggagaauaaagcguggcuggugcacagacagugguuucuugaccugccgcucccuuggcugcccggcgccgauacacagggguccaacuggauccagaaggagacccuggucacauucaagaauccucaugcuaaaaagcaagacgugguugugcucggaucccaggaaggcgccaugcacaccgcucugacgggggccacagagauccagaugucuagcggcaaccuucuguuuaccggacaucucaaaugccggcugagaauggacaagcugcaacugaaaggcauguccuacagcauguguacagggaaguucaaggucgugaaagaaauugccgagacccagcacggaaccaucgucauucgcgugcaguaugagggcgaugggucucccugcaagauccccuucgaaauuauggaccucgagaaacggcauguucugggaagacugaucacagugaacccuaucgucacggaaaaggauuccccggugaauauugaggcugaacccccuuuuggcgacagcuacaucauuaucgggguugagcccggccagcucaaacugaacugguucaagaagggaucuagcauuggccaaauguuugagaccacaaugcgcggggcgaaacggauggccauccuuggagauaccgcuugggacuucggcucccuugggggaguguuuacaucuauuggcaaggcccuccaccaggucuucggggccaucuacggcgcugccuuuagcggaguguccuggaccaugaaaauccugauuggcgugaucauuacguggaucgggaugaauagcagaucuacaucccugagcguuacccuuguccucgugggaauugugacccuguaucugggcgucauggugcaggcg

SEQ ID NO: 2067 - RNA, 2325 nt, Artificial Sequence
  derived and/or modified CDS sequence (opt5) from DENV-2 CYD2-T__C-prME
augaacaaucagagaaagaaagccaagaacacccccuucaauaugcugaaacgggagcgcaacagagugagcacaguccaacagcucacgaagcgguuuucccugggcaugcuucaggggcgcggaccucugaaacucuucauggcucugguugccuuucuuagauuccugaccaucccgcccacagcgggcauucucaagcggugggggaccaucaagaaaucuaaggcuauuaaugugcugcgcggauuuagaaaagaaaucggccggaugcugaacauucucaaucgcagacggcgcagcgccgggaugaucaucaugcugauuccuacagugauggccuuccaccuuaccacaagaaacggagagccccauaugaucgucucccggcaggaaaagggcaaaucucugcucuuuaagaccgaggacggcgugaauaugugcacgcugauggcuauggaucuuggggaacugugugaggacaccauuacauacaagugcccucuccugcgccaaaacgagcccgaagauaucgacuguuggugcaauagcaccuccacauggguuaccuauggaacguguacaaccaugggcgagcacagacgggagaaaagaucuguggcccuggucccucauguggggaugggacucgagacacgcaccgagaccuggaugagcuccgaaggcgcuuggaagcacguucagcggauugagacauggauccugagacauccgggguucacgaugauggccgcgauucuugccuacaccaucggaacaacccacuuucagcgcgcucugaucuucauucuccugacagccgugacccccagcaugacgaugcggugcaucggcaugucuaacagagauuuugucgaaggcguguccgggggaagcuggguggacauuguccuugagcacggcucuuguguuacaaccauggcuaaaaauaagccuacccuggauuucgaacucaucaaaacagaggccaagcagcccgcgacccugcgcaaauauugcauugaggccaagcugacaaacacgaccacagaaucccgguguccuacccaaggggagcccagccucaaugaagaacaggacaagagauuugugugcaaacauucuaugguggaucgcggauggggcaacggguguggacuguucggcaagggcgggaucgucacaugcgcuauguuccggugcaaaaagaacauggaaggaaaagugguucagccggagaaucuugaguacaccaucgugauuacgccucacuccggcgaggaacaugccgucgggaacgacaccggaaagcacggcaaggaaaucaaaauuacaccccagagcuccaucaccgaggcugaacugacaggguauggcaccgugacgauggaguguucuccuagaacaggacucgauuuuaaugagaugguucugcuucaaauggaaaacaaggccuggcuggugcaccgccagugguuccucgaccugccccugcccuggcucccuggcgccgauacccaggggagcaauuggauucaaaaagagacacuggucaccuuuaagaacccgcaugcuaaaaagcaggacguggucgugcuuggaucccaggaaggcgcgaugcacaccgcccugacaggggcuacggagauccagaugagcucuggaaaucuccuguucaccggccaucugaagugccggcuuagaauggacaaacuccaacugaaggggauguccuacagcauguguacaggcaaauuuaagguugugaaagagaucgccgaaacccagcacggaacaauugucauccgggugcaguaugagggcgaugggucucccugcaagauuccuuucgaaaucauggaccuggagaagcgccauguucucggaagacugauuaccgugaaccccaucgucacggaaaaagauagcccugugaauauugaggccgagcccccguuuggcgacuccuacaucaucauugggguggaaccuggacagcuuaagcugaacugguucaaaaagggcucuagcaucgggcaaauguuugagacaaccaugcggggcgcuaaaagaauggccauucucggagauaccgcgugggacuucggcucccuugggggaguuuuuacaagcaucggcaaggcucugcaccaggucuucggggccauuuacggagccgcuuuuucuggcguguccuggaccaugaaaauccugaucggggugauuaucacauggauuggcaugaauagccgcucuacgucccucagcgucacccuggugcugguuggaaucgugacacucuaucugggcgucauggugcaggcc

SEQ ID NO: 2068 - RNA, 45 nt, Artificial Sequence
  derived and/or modified CDS sequence (opt5) from DENV-2 CYD2-T__SSc
augagcgccggcaugaucauuaugcugauccccaccgugauggcu

SEQ ID NO: 2069 - RNA, 57 nt, Artificial Sequence
  derived and/or modified CDS sequence (opt5) from DENV-2 CYD2-T__SSopt
augaagagaaagaaaagcgccggcaugaucauuaugcugauccccaccgugauggcu

SEQ ID NO: 2070 - RNA, 57 nt, Artificial Sequence
  derived and/or modified CDS sequence (opt5) from DENV-2 CYD2-T__SSm
auguuccagagagcccugaucuuuauucuccugaccgcugugacacccagcaugacg

SEQ ID NO: 2071 - RNA, 1488 nt, Artificial Sequence
  derived and/or modified CDS sequence (opt5) from DENV-2 CYD2-T__E
augagaugcaucggcaugagcaaccgggacuucguggagggggucuccggaggcucuuggguugauauugugcuggaacacgggagcugugugaccacaauggccaagaauaaacccacgcucgacuuugagcugaucaagaccgaagcuaaacagccugccacacuucgcaaguacugcauugaggcgaaacugaccaacacaaccacagaauccagauguccgacccaaggagagcccucucucaaugaggaacaggauaagcgguucgucugcaagcauagcaugguggaccgcggcugggggaacggauguggccuguuuggcaaagggggaaucguuacgugcgcuauguucagauguaagaaaaauauggagggcaaggugguccagccugaaaaccuugaguauaccauugugaucacaccccacuccggggaggaacaugccguuggaaaugauaccggcaaacacgggaaggagaucaagauuacaccucagucuagcaucaccgaagccgagcugacgggauacggcacagugaccauggaaugcagcccccggacaggccucgacuuuaacgagaugguccugcugcaaauggagaauaaggcuuggcucgugcaucgccagugguuccuggaucuuccucugccguggcuccccggggccgacacccagggauccaacuggauucagaaagaaacccuggugacauuuaaaaauccucacgcuaagaaacaagaugucguugugcuuggcucucaggagggggccaugcacacggcgcugaccggagccacagaaauccagauguccagcggcaaccuccuguucaccgggcaucugaaguguagacuccggauggacaaacugcagcuuaagggaaugucuuauuccaugugcacaggcaaguuuaaaguggucaaggagauugcugaaacccaacacggcacgaucgugauucgcguucaguacgagggggauggaagccccuguaaaaucccuuucgagaucauggaccuggaaaagagacaugugcucggccggcugauuacagucaaucccaucgugaccgagaaagauucuccgguuaacauugaagccgagccucccuuuggggacuccuauaucauuaucggaguggaaccuggccagcuuaagcugaauugguucaagaaagggagcuccaucggccaaauguuugagaccacaaugcgcggagcuaagagaauggccauucucggcgacaccgcgugggauuucgggucucugggaggcgucuucacaagcaucgggaaagcccugcaccagguguuuggagcuauuuacggcgccgcuuucuccggggucagcuggacgaugaagauccucauuggcgugaucaucaccuggauuggaaugaacucucgguccacaagccugucuguuacccuugugcuggucggcaucgugacacucuaucuggggguuauggugcaggccuga

SEQ ID NO: 2072 - RNA, 1182 nt, Artificial Sequence
  derived and/or modified CDS sequence (opt5) from DENV-2 CYD2-T__EdelTM-variant (aa1-394)
augagaugcaucggcaugagcaaccgggacuucguggagggggucuccggaggcucuuggguugauauugugcuggaacacgggagcugugugaccacaauggccaagaauaaacccacgcucgacuuugagcugaucaagaccgaagcuaaacagccugccacacuucgcaaguacugcauugaggcgaaacugaccaacacaaccacagaauccagauguccgacccaaggagagcccucucucaaugaggaacaggauaagcgguucgucugcaagcauagcaugguggaccgcggcugggggaacggauguggccuguuuggcaaagggggaaucguuacgugcgcuauguucagauguaagaaaaauauggagggcaaggugguccagccugaaaaccuugaguauaccauugugaucacaccccacuccggggaggaacaugccguuggaaaugauaccggcaaacacgggaaggagaucaagauuacaccucagucuagcaucaccgaagccgagcugacgggauacggcacagugaccauggaaugcagcccccggacaggccucgacuuuaacgagaugguccugcugcaaauggagaauaaggcuuggcucgugcaucgccagugguuccuggaucuuccucugccguggcuccccggggccgacacccagggauccaacuggauucagaaagaaacccuggugacauuuaaaaauccucacgcuaagaaacaagaugucguugugcuuggcucucaggagggggccaugcacacggcgcugaccggagccacagaaauccagauguccagcggcaaccuccuguucaccgggcaucugaaguguagacuccggauggacaaacugcagcuuaagggaaugucuuauuccaugugcacaggcaaguuuaaaguggucaaggagauugcugaaacccaacacggcacgaucgugauucgcguucaguacgagggggauggaagccccuguaaaaucccuuucgagaucauggaccuggaaaagagacaugugcucggccggcugauuacagucaaucccaucgugaccgagaaagauucuccgguuaacauugaagccgagccucccuuuggggacuccuauaucauuaucggaguggaaccuggccagcuuaagcugaauugguucaagaaa

SEQ ID NO: 2073 - RNA, 1272 nt, Artificial Sequence
  derived and/or modified CDS sequence (opt5) from DENV-2 CYD2-T__EdelTM-variant (aa1-424)
augagaugcaucggcaugagcaaccgggacuucguggagggggucuccggaggcucuuggguugauauugugcuggaacacgggagcugugugaccacaauggccaagaauaaacccacgcucgacuuugagcugaucaagaccgaagcuaaacagccugccacacuucgcaaguacugcauugaggcgaaacugaccaacacaaccacagaauccagauguccgacccaaggagagcccucucucaaugaggaacaggauaagcgguucgucugcaagcauagcaugguggaccgcggcugggggaacggauguggccuguuuggcaaagggggaaucguuacgugcgcuauguucagauguaagaaaaauauggagggcaaggugguccagccugaaaaccuugaguauaccauugugaucacaccccacuccggggaggaacaugccguuggaaaugauaccggcaaacacgggaaggagaucaagauuacaccucagucuagcaucaccgaagccgagcugacgggauacggcacagugaccauggaaugcagcccccggacaggccucgacuuuaacgagaugguccugcugcaaauggagaauaaggcuuggcucgugcaucgccagugguuccuggaucuuccucugccguggcuccccggggccgacacccagggauccaacuggauucagaaagaaacccuggugacauuuaaaaauccucacgcuaagaaacaagaugucguugugcuuggcucucaggagggggccaugcacacggcgcugaccggagccacagaaauccagauguccagcggcaaccuccuguucaccgggcaucugaaguguagacuccggauggacaaacugcagcuuaagggaaugucuuauuccaugugcacaggcaaguuuaaaguggucaaggagauugcugaaacccaacacggcacgaucgugauucgcguucaguacgagggggauggaagccccuguaaaaucccuuucgagaucauggaccuggaaaagagacaugugcucggccggcugauuacagucaaucccaucgugaccgagaaagauucuccgguuaacauugaagccgagccucccuuuggggacuccuauaucauuaucggaguggaaccuggccagcuuaagcugaauugguucaagaaagggagcuccaucggccaaauguuugagaccacaaugcgcggagcuaagagaauggccauucucggcgacaccgcgugggauuucgggucu

SEQ ID NO: 2074 - RNA, 1263 nt, Artificial Sequence
  derived and/or modified CDS sequence (opt5) from DENV-2 CYD2-T__EdelTM-variant (aa1-421)
augagaugcaucggcaugagcaaccgggacuucguggagggggucuccggaggcucuuggguugauauugugcuggaacacgggagcugugugaccacaauggccaagaauaaacccacgcucgacuuugagcugaucaagaccgaagcuaaacagccugccacacuucgcaaguacugcauugaggcgaaacugaccaacacaaccacagaauccagauguccgacccaaggagagcccucucucaaugaggaacaggauaagcgguucgucugcaagcauagcaugguggaccgcggcugggggaacggauguggccuguuuggcaaagggggaaucguuacgugcgcuauguucagauguaagaaaaauauggagggcaaggugguccagccugaaaaccuugaguauaccauugugaucacaccccacuccggggaggaacaugccguuggaaaugauaccggcaaacacgggaaggagaucaagauuacaccucagucuagcaucaccgaagccgagcugacgggauacggcacagugaccauggaaugcagcccccggacaggccucgacuuuaacgagaugguccugcugcaaauggagaauaaggcuuggcucgugcaucgccagugguuccuggaucuuccucugccguggcuccccggggccgacacccagggauccaacuggauucagaaagaaacccuggugacauuuaaaaauccucacgcuaagaaacaagaugucguugugcuuggcucucaggagggggccaugcacacggcgcugaccggagccacagaaauccagauguccagcggcaaccuccuguucaccgggcaucugaaguguagacuccggauggacaaacugcagcuuaagggaaugucuuauuccaugugcacaggcaaguuuaaaguggucaaggagauugcugaaacccaacacggcacgaucgugauucgcguucaguacgagggggauggaagccccuguaaaaucccuuucgagaucauggaccuggaaaagagacaugugcucggccggcugauuacagucaaucccaucgugaccgagaaagauucuccgguuaacauugaagccgagccucccuuuggggacuccuauaucauuaucggaguggaaccuggccagcuuaagcugaauugguucaagaaagggagcuccaucggccaaauguuugagaccacaaugcgcggagcuaagagaauggccauucucggcgacaccgcgugggau

SEQ ID NO: 2075 - RNA, 2031 nt, Artificial Sequence
  derived and/or modified CDS sequence (opt5) from DENV-2 CYD2-T__SSc-prME
augagcgccggcaugaucauuaugcugauccccaccgugauggcuuuccaccucacaacgagaaacggggagccucauaugauugucucccggcaggaaaagggaaaaucucugcuuuuuaagaccgaggacggcguuaauaugugcacacugauggccauggaucucggggaacugugugaggacaccaucacauacaaaugcccgcuucugcgccaaaacgaacccgaggauauugacuguuggugcaauagcaccuccacaugggugaccuauggaacguguaccacaaugggcgagcacagacgggaaaagcgcucuguggcgcucgucccucauguggggaugggacuggagaccagaacagaaaccuggaugagcuccgagggcgcuuggaaacacguucagcggaucgagacguggauccugcgccaucccggcuucacaaugauggccgccauucucgcuuacaccaucgggacaacccacuuucagagagcccugauuuucauccuucugaccgcugugacaccuucuaugacgaugcggugcauuggaaugagcaaccgcgauuuugucgaaggcguguccgggggaagcuggguugacaucgugcucgagcacggcucuugugucaccacaauggccaagaauaagcccacccuggauuucgaacuuauuaaaacagaggcgaagcagccugccacccugagaaaauauugcaucgaagcuaagcucacgaacacaaccaccgagucccgguguccgacacaaggggagcccagccugaaugaggaacaggacaaacgcuuugugugcaagcauucuaugguggauagaggauggggcaacggcugugggcuguucggaaagggcgggaucguuaccugcgccauguuucggugcaaaaagaauauggaaggaaaagucgugcagccugagaaccucgaauacacaauugugaucacgccccacuccggcgaggagcaugcugucgggaaugacaccggaaagcacggcaaagaaauuaagaucacaccucagagcucuauuaccgaggccgaacugacaggcuaugggaccgugacgauggaguguagcccccgcaccggacuugauuucaacgaaaugguucugcuccaaauggagaauaaagcguggcuggugcacagacagugguuucuugaccugccgcucccuuggcugcccggcgccgauacacagggguccaacuggauccagaaggagacccuggucacauucaagaauccucaugcuaaaaagcaagacgugguugugcucggaucccaggaaggcgccaugcacaccgcucugacgggggccacagagauccagaugucuagcggcaaccuucuguuuaccggacaucucaaaugccggcugagaauggacaagcugcaacugaaaggcauguccuacagcauguguacagggaaguucaaggucgugaaagaaauugccgagacccagcacggaaccaucgucauucgcgugcaguaugagggcgaugggucucccugcaagauccccuucgaaauuauggaccucgagaaacggcauguucugggaagacugaucacagugaacccuaucgucacggaaaaggauuccccggugaauauugaggcugaacccccuuuuggcgacagcuacaucauuaucgggguugagcccggccagcucaaacugaacugguucaagaagggaucuagcauuggccaaauguuugagaccacaaugcgcggggcgaaacggauggccauccuuggagauaccgcuugggacuucggcucccuugggggaguguuuacaucuauuggcaaggcccuccaccaggucuucggggccaucuacggcgcugccuuuagcggaguguccuggaccaugaaaauccugauuggcgugaucauuacguggaucgggaugaauagcagaucuacaucccugagcguuacccuuguccucgugggaauugugacccuguaucugggcgucauggugcaggcguga

SEQ ID NO: 2076 - RNA, 2031 nt, Artificial Sequence
  derived and/or modified CDS sequence (opt5) from DENV-2 CYD2-T__SSc-prME(F108S)
augagcgccggcaugaucauuaugcugauccccaccgugauggcuuuccaccucacaacgagaaauggggagccucauaugauugucucccggcaggaaaagggaaaaucucugcuuuuuaagaccgaggacggcguuaauaugugcacacugauggccauggaucucggggaacugugugaggacaccaucacauacaaaugcccgcuucugcgccaaaacgaacccgaggauauugacuguuggugcaauagcaccuccacaugggugaccuauggaacguguaccacaaugggcgagcacagacgggaaaagcgcucuguggcgcucgucccucauguggggaugggacuggagaccagaacagaaaccuggaugagcuccgagggcgcuuggaaacacguucagcggaucgagacguggauccugcgccaucccggcuucacaaugauggccgccauucucgcuuacaccaucgggacaacccacuuucagagagcccugauuuucauccuucugaccgcugugacaccuucuaugacgaugcggugcauuggaaugagcaaccgcgauuuugucgaaggcguguccgggggaagcuggguugacaucgugcucgagcacggcucuugugucaccacaauggccaagaauaagcccacccuggauuucgaacuuauuaaaacagaggcgaagcagccugccacccugagaaaauauugcaucgaagcuaagcucacgaacacaaccaccgagucccgguguccgacacaaggggagcccagccugaaugaggaacaggacaaacgcuuugugugcaagcauucuaugguggauagaggauggggcaacggcugugggcuguccggaaagggcgggaucguuaccugcgccauguuccggugcaaaaagaauauggaaggaaaagucgugcagccugagaaccucgaauacacaauugugaucacgccccacagcggcgaggagcaugcugucgggaaugacaccggaaagcacggcaaagaaauuaagaucacaccucagucuuccauuaccgaggccgaacugacaggcuaugggaccgugacgauggaguguagcccccgcaccggacuugauuuuaacgaaaugguucugcuccaaauggagaauaaagcguggcuggugcacagacagugguuccuugaccugccgcucccuuggcugcccggcgccgauacacagggguccaacuggauccagaaggagacccuggucacauuuaagaauccucaugcuaaaaagcaagacgugguugugcucggaucucaggaaggcgccaugcacaccgcucugacgggggccacagagauccagaugagcuccggcaaccuucuguucaccggacaucucaaaugccggcugagaauggacaagcugcaacugaaaggcaugagcuacucuauguguacagggaaguuuaaggucgugaaagaaauugccgagacccagcacggaaccaucgucauucgcgugcaguaugagggcgaugggucccccugcaagauccccuucgaaauuauggaccucgagaaacggcauguucugggaagacugaucacagugaacccuaucgucacggaaaaggauagcccggugaauauugaggcugaacccccuuucggcgacucuuacaucauuaucgggguugagcccggccagcucaaacugaacugguuuaagaagggaagcuccauuggccaaauguucgagaccacaaugcgcggggcgaaacggauggccauccuuggagauaccgcuugggacuuuggcucucuugggggaguguucacaagcauuggcaaggcccuccaccaggucuuuggggccaucuacggcgcugccuucuccggagugagcuggaccaugaaaauccugauuggcgugaucauuacguggaucgggaugaacucuagauccacaagccugucuguuacccuuguccucgugggaauugugacccuguaucugggcgucauggugcaggcguga

SEQ ID NO: 2077 - RNA, 2031 nt, Artificial Sequence
  derived and/or modified CDS sequence (opt5) from DENV-2 CYD2-T__SSc-prMEdelstem_TM-JEV
augagcgccggcaugaucauuaugcugauccccaccgugauggcuuuccaccucacaacgagaaacggggagccucauaugauugucucccggcaggaaaagggaaaaucucugcuuuuuaagaccgaggacggcguuaauaugugcacacugauggccauggaucucggggaacugugugaggacaccaucacauacaaaugcccgcuucugcgccaaaacgaacccgaggauauugacuguuggugcaauagcaccuccacaugggugaccuauggaacguguaccacaaugggcgagcacagacgggaaaagcgcucuguggcgcucgucccucauguggggaugggacuggagaccagaacagaaaccuggaugagcuccgagggcgcuuggaaacacguucagcggaucgagacguggauccugcgccaucccggcuucacaaugauggccgccauucucgcuuacaccaucgggacaacccacuuucagagagcccugauuuucauccuucugaccgcugugacaccuucuaugacgaugcggugcauuggaaugagcaaccgcgauuuugucgaaggcguguccgggggaagcuggguugacaucgugcucgagcacggcucuugugucaccacaauggccaagaauaagcccacccuggauuucgaacuuauuaaaacagaggcgaagcagccugccacccugagaaaauauugcaucgaagcuaagcucacgaacacaaccaccgagucccgguguccgacacaaggggagcccagccugaaugaggaacaggacaaacgcuuugugugcaagcauucuaugguggauagaggauggggcaacggcugugggcuguucggaaagggcgggaucguuaccugcgccauguuucggugcaaaaagaauauggaaggaaaagucgugcagccugagaaccucgaauacacaauugugaucacgccccacuccggcgaggagcaugcugucgggaaugacaccggaaagcacggcaaagaaauuaagaucacaccucagagcucuauuaccgaggccgaacugacaggcuaugggaccgugacgauggaguguagcccccgcaccggacuugauuucaacgaaaugguucugcuccaaauggagaauaaagcguggcuggugcacagacagugguuucuugaccugccgcucccuuggcugcccggcgccgauacacagggguccaacuggauccagaaggagacccuggucacauucaagaauccucaugcuaaaaagcaagacgugguugugcucggaucccaggaaggcgccaugcacaccgcucugacgggggccacagagauccagaugucuagcggcaaccuucuguuuaccggacaucucaaaugccggcugagaauggacaaacuucaacugaagggcauguccuacagcauguguacagggaaguucaaggucgugaaagaaauugccgagacccagcacggaaccaucgucauucgcgugcaguaugagggcgaugggucucccugcaagauccccuucgaaauuauggaccucgagaaacggcauguucugggaagacugaucacagugaacccuaucgucacggaaaaggauuccccggugaauauugaggcugaacccccuuuuggcgacagcuacaucauuaucgggguugagcccggccagcucaaacugaacugguucaagaagggaucuacccuuggcaaagcguuuagcacaacccugaagggggcccaacgccucgcugcccugggagauacagccugggacuucggcuccauugggggaguguuuaauucuaucggccgggcuguccaccagguguucgggggcgccuuuagaacccuguucggaggcaugagcuggauuacgcaggggcuuaugggagcgcuccugcuguggaugggcgugaacgcucgcgaucgguccaucgcccucgccuuucuggcuacagggggaguucuugucuuccuggccaccaaugugcacgcuuga

SEQ ID NO: 2078 - RNA, 1332 nt, Artificial Sequence
  derived and/or modified CDS sequence (opt5) from DENV-2 CYD2-T__SSm-EdelTM
auguuccagagagcccugaucuuuauucuccugaccgcugugacacccagcaugacgaugcggugcaucggcauguccaaccgcgacuucgucgaggggguuucuggaggcagcuggguggauauugugcuugaacacggguccugugucaccacaauggccaagaauaaaccuacccuggacuuugagcucaucaagacagaagcgaaacaaccggcuacccugagaaaguacugcauugaggccaaacuuacaaacaccacgaccgaaucucggugucccacacagggagagccuagccugaaugaggaacaggauaagcgcuucgugugcaagcauuccaugguugacagaggcugggggaacggauguggccucuuuggcaaagggggaaucgugaccugcgccauguuccgguguaagaaaaauauggagggcaaggucgugcagcccgaaaaccuggaguauacaaucguuauuaccccucacucuggggaggaacaugcugugggaaaugauacgggcaaacacgggaaggagaucaagauuacaccccaaagcuccaucaccgaagccgagcugacaggauacggcaccgucaccauggaaugcagcccucgcacaggccucgacuuuaacgagauggugcugcuucagauggagaauaaggcuuggcuggugcauagacagugguuccucgaucugccgcuucccuggcugccuggggccgacacgcagggaucuaacuggauucaaaaagaaacccucgucacauuuaaaaauccccacgcgaagaaacaggauguuguggugcugggcucccaggagggggccaugcacaccgcucugacaggagccaccgaaauccagaugagcucuggcaaccuccuguucacggggcaucuuaagugucggcugcgcauggacaaacuccaacugaagggaauguccuauagcaugugcacaggcaaguuuaaagucgugaaggagauugcugaaacccagcacggcaccaucguuaucagagugcaguacgagggggauggaucuccuuguaaaauucccuucgagaucauggaccuugaaaagcggcauguccugggccgccucauuacagugaauccgaucguuaccgagaaagauuccccugugaacauugaagccgagcccccuuuuggggacagcuauaucaucauuggagucgaacccggccaacugaagcugaauugguucaagaaaggguccucuaucggccagauguucgagacaacgaugagaggagcgaagcggauggccauucucggcgacaccgcuugggauuuugggagcuga

SEQ ID NO: 2079 - RNA, 2379 nt, Artificial Sequence
  derived and/or modified CDS sequence (opt5) from DENV-2 CYD2-T__C-P2A-SSc-prME
augaacaaucagagaaagaaagccaagaacacccccuucaauaugcugaaacgggagcgcaacagagugagcacaguccaacagcucacgaagcgguuuucccugggcaugcuucaggggcgcggaccucugaaacucuucauggcucugguugccuuucuuagauuccugaccaucccgcccacagcgggcauucucaagcggugggggaccaucaagaaaucuaaggcuauuaaugugcugcgcggauuuagaaaagaaaucggccggaugcugaacauucucaaucgcagacggcgcaacuucgaccugcuuaagcuggccggggauguggagagcaauccuggacccuccgccggcaugaucaucaugcucauuccuacagucauggcuuuucaccugaccacaagaaacggcgaaccccauaugaucgugucucggcaggagaaagggaagucucuucuguucaagaccgaagacggaguuaauaugugcacgcucauggccauggaucugggcgagcugugugaggacaccauuacauacaaaugcccucuccugcgccaaaacgaaccggaggauaucgacuguuggugcaauuccaccucuacaugggugaccuaugggacguguacaaccaugggagaacacagacgggagaagagaagcgucgcucuugugccccauguuggcauggggcuggagacacgcaccgaaaccuggauguccagcgagggagccuggaaacacgugcagcggauugaaacauggauccucagacauccuggcuuuacgaugauggcggccauucuggcuuacaccaucggcacaacccacuuccagcgcgcccuuaucuuuauucugcucacagcugucacccccucuaugacgaugcggugcaucgggauguccaacagagauuucguggagggagugagcggcgggucuugggucgacauuguucuggaacacggauccugugugacaaccauggccaagaauaaaccuacccuggauuuugagcucaucaagacagaggcgaaacagcccgccacccugcgcaaguauugcauugaagcuaaacuuacaaacacgaccacagagagccgguguccgacccaaggcgaaccuucucugaacgaggaacaggacaagagauucgugugcaagcauuccauggucgaucgcggguggggaaauggcuguggccucuucgggaaaggaggcaucgugacaugcgccauguuucggugcaagaaaaacauggaggggaagguugugcagcccgagaaucuggaauacaccaucgucauuacgccucacagcggagaggaacaugcugugggcaacgacaccgggaagcacggcaaagagaucaagauuacaccccaguccucuaucaccgaagccgagcuuacaggauauggcaccguuacgauggaguguagccccagaacagggcuggauuucaaugaaauggugcuccugcaaauggagaacaaagccuggcugguccaccgccagugguuucucgaccugccucuuccguggcugcccggagcugacacccagggcuccaauuggauucaaaaggaaacacucgugaccuucaaaaacccucaugcgaagaagcaggaugucgugguucuggggagccaggagggagccaugcacaccgcucugacaggcgccacggagauccagaugucuuccgggaaucuucucuuuaccggccaucugaaaugccggcugagaauggacaagcuccaacugaaaggaaugagcuacucuauguguacaggcaaguucaaaguggucaaggaaaucgccgagacccagcacgggacaauugugauccggguucaguaugaaggagauggcagccccugcaagauuccuuuugagaucauggaccuugaaaaacgccaugugcuggggagacucauuaccgucaaccccaucgugacggagaaggauuccccggugaauauugaggcugaaccucccuucggagacucuuacaucaucauuggcguugagccugggcagcugaaacugaacugguuuaagaaaggcagcuccaucggacaaauguucgaaacaaccaugcggggcgccaagagaauggcgauucuuggggauaccgcuugggacuuuggaagccucggcggggucuucacaucuaucggaaaagcccugcaccagguguuuggcgccauuuacggggcugccuucuccggcgugagcuggaccaugaagauccugaucggagucauuaucacauggauuggcaugaauagccgcuccacgagccucuccgugacccugguucuuguggggaucgucacacuguaucucggagugaugguucaggcuuga

SEQ ID NO: 2080 - RNA, 2043 nt, Artificial Sequence
  derived and/or modified CDS sequence (opt5) from DENV-2 CYD2-T__SSopt-prME(F108S)
augaagcggaaaaagagcgccggcaugaucauuaugcugauccccaccgugauggcuuuccaccucacaacgcggaauggggagccucauaugauugucucccgccaggaaaaaggaaagucucugcuuuuuaaaaccgaggacggcguuaauaugugcacacugauggccauggaucucggggaacugugugaggacaccaucacauacaagugcccgcuucugagacaaaacgaacccgaggauauugacuguuggugcaauagcaccuccacaugggugaccuauggaacguguaccacaaugggcgagcaccggcgcgaaaagagaucuguggcgcucgucccucauguggggaugggacuggagacccggacagaaaccuggaugagcuccgagggcgcuuggaaacacguucagcgcaucgagacguggauccugagacaucccggcuucacaaugauggccgccauucucgcuuacaccaucgggacaacccacuuucagcgggcccugauuuucauccuucugaccgcugugacaccuucuaugacgaugcgcugcauuggaaugagcaacagagauuuugucgaaggcguguccgggggaagcuggguugacaucgugcucgagcacggcucuugugucaccacaauggccaagaauaaacccacccuggauuucgaacuuauuaagacagaggcgaaacagccugccacccugcggaaguauugcaucgaagcuaagcucacgaacacaaccaccgagucccgcuguccgacacaaggggagcccagccugaaugaggaacaggacaaaagauuugugugcaagcauucuaugguggaucggggauggggcaacggcugugggcuguccggaaaaggcgggaucguuaccugcgccauguuccgcugcaagaaaaauauggaaggaaaggucgugcagccugagaaccucgaauacacaauugugaucacgccccacagcggcgaggagcaugcugucgggaaugacaccggaaaacacggcaaggaaauuaagaucacaccucagucuuccauuaccgaggccgaacugacaggcuaugggaccgugacgauggaguguagccccagaaccggacuugauuuuaacgaaaugguucugcuccaaauggagaauaaagcguggcuggugcaccggcagugguuccuugaccugccgcucccuuggcugcccggcgccgauacacagggguccaacuggauccagaaggagacccuggucacauuuaaaaauccucaugcuaagaaacaagacgugguugugcucggaucucaggaaggcgccaugcacaccgcucugacgggggccacagagauccagaugagcuccggcaaccuucuguucaccggacaucucaagugcagacugcgcauggacaagcugcaacugaaaggcaugagcuacucuauguguacagggaaguuuaaagucgugaaggaaauugccgagacccagcacggaaccaucgucauucgggugcaguaugagggcgaugggucccccugcaaaauccccuucgaaauuauggaccucgagaagagacauguucugggacgccugaucacagugaacccuaucgucacggaaaaggauagcccggugaauauugaggcugaacccccuuucggcgacucuuacaucauuaucgggguugagcccggccagcucaaacugaacugguuuaagaaaggaagcuccauuggccaaauguucgagaccacaaugagaggggcgaagagaauggccauccuuggagauaccgcuugggacuuuggcucucuugggggaguguucacaagcauuggcaaagcccuccaccaggucuuuggggccaucuacggcgcugccuucuccggagugagcuggaccaugaagauccugauuggcgugaucauuacguggaucgggaugaacucucgcuccacaagccugucuguuacccuuguccucgugggaauugugacccuguaucugggcgucauggugcaggcguga

SEQ ID NO: 2081 - RNA, 2043 nt, Artificial Sequence
  derived and/or modified CDS sequence (opt5) from DENV-2 CYD2-T__SSopt-prME(M96H)
augaagcggaaaaagagcgccggcaugaucauuaugcugauccccaccgugauggcuuuccaccucacaacgcggaacggggagccucauaugauugucucccgccaggaaaaaggaaagucucugcuuuuuaaaaccgaggacggcguuaauaugugcacacugauggccauggaucucggggaacugugugaggacaccaucacauacaagugcccgcuucugagacaaaacgaacccgaggauauugacuguuggugcaauagcaccuccacaugggugaccuauggaacguguaccacaaugggcgagcaccggcgcgaaaagagaucuguggcgcucgucccucauguggggaugggacuggagacccggacagaaaccuggaugagcuccgagggcgcuuggaaacacguucagcgcaucgagacguggauccugagacaucccggcuucacaaugauggccgccauucucgcuuacaccaucgggacaacccacuuucagcgggcccugauuuucauccuucugaccgcugugacaccuucuaugacgaugcgcugcauuggaaugagcaacagagauuuugucgaaggcguguccgggggaagcuggguugacaucgugcucgagcacggcucuugugucaccacaauggccaagaauaaacccacccuggauuucgaacuuauuaagacagaggcgaaacagccugccacccugcggaaguauugcaucgaagcuaagcucacgaacacaaccaccgagucccgcuguccgacacaaggggagcccagccugaaugaggaacaggacaaaagauuugugugcaagcauucucacguggaucggggauggggcaacggcugugggcuguucggaaaaggcgggaucguuaccugcgccauguuucgcugcaagaaaaauauggaaggaaaggucgugcagccugagaaccucgaauacacaauugugaucacgccccauuccggcgaggagcacgcugucgggaaugacaccggaaaacacggcaaggaaauuaagaucacaccucagagcucuauuaccgaggccgaacugacaggcuaugggaccgugacgauggaguguucccccagaaccggacuugauuucaacgaaaugguucugcuccaaauggagaauaaagcguggcuggugcaucggcagugguuucuugaccugccgcucccuuggcugcccggcgccgauacacaggggagcaacuggauccagaaggagacccuggucacauucaaaaauccucacgcuaagaaacaagacgugguugugcucggaucccaggaaggcgccaugcauaccgcucugacgggggccacagagauccagaugucuagcggcaaccuucuguuuaccggacaccucaagugcagacugcgcauggacaagcugcaacugaaaggcauguccuacagcauguguacagggaaguucaaagucgugaaggaaauugccgagacccagcauggaaccaucgucauucgggugcaguaugagggcgaugggucucccugcaaaauccccuucgaaauuauggaccucgagaagagacacguucugggacgccugaucacagugaacccuaucgucacggaaaaggauuccccggugaauauugaggcugaacccccuuuuggcgacagcuacaucauuaucgggguugagcccggccagcucaaacugaacugguucaagaaaggaucuagcauuggccaaauguuugagaccacaaugagaggggcgaagagaauggccauccuuggagauaccgcuugggacuucggcucccuugggggaguguuuacaucuauuggcaaagcccuccaccaggucuucggggccaucuacggcgcugccuuuagcggaguguccuggaccaugaagauccugauuggcgugaucauuacguggaucgggaugaauagccgcucuacaucccugagcguuacccuuguccucgugggaauugugacccuguaucugggcgucauggugcaggcguga

SEQ ID NO: 2082 - RNA, 2043 nt, Artificial Sequence
  derived and/or modified CDS sequence (opt5) from DENV-2 CYD2-T__SSopt-prME(S186F)
augaagcggaaaaagagcgccggcaugaucauuaugcugauccccaccgugauggcuuuccaccucacaacgcggaauggggagccucauaugauugucucccgccaggaaaaaggaaagucucugcuuuuuaaaaccgaggacggcguuaauaugugcacacugauggccauggaucucggggaacugugugaggacaccaucacauacaagugcccgcuucugagacaaaacgaacccgaggauauugacuguuggugcaauagcaccuccacaugggugaccuauggaacguguaccacaaugggcgagcaccggcgcgaaaagagaucuguggcgcucgucccucauguggggaugggacuggagacccggacagaaaccuggaugagcuccgagggcgcuuggaaacacguucagcgcaucgagacguggauccugagacaucccggcuucacaaugauggccgccauucucgcuuacaccaucgggacaacccacuuucagcgggcccugauuuucauccuucugaccgcugugacaccuucuaugacgaugcgcugcauuggaaugagcaacagagauuuugucgaaggcguguccgggggaagcuggguugacaucgugcucgagcacggcucuugugucaccacaauggccaagaauaaacccacccuggauuucgaacuuauuaagacagaggcgaaacagccugccacccugcggaaguauugcaucgaagcuaagcucacgaacacaaccaccgagucccgcuguccgacacaaggggagcccagccugaaugaggaacaggacaaaagauuugugugcaagcauucuaugguggaucggggauggggcaacggcugugggcuguucggaaaaggcgggaucguuaccugcgccauguuucgcugcaagaaaaauauggaaggaaaggucgugcagccugagaaccucgaauacacaauugugaucacgccccacuccggcgaggagcaugcugucgggaaugacaccggaaaacacggcaaggaaauuaagaucacaccucagagcucuauuaccgaggccgaacugacaggcuaugggaccgugacgauggaguguuuccccagaaccggacuugauuuuaacgaaaugguucugcuccaaauggagaauaaagcguggcuggugcaccggcagugguuccuugaccugccgcucccuuggcugcccggcgccgauacacagggguccaacuggauccagaaggagacccuggucacauuuaaaaauccucaugcuaagaaacaagacgugguugugcucggaagccaggaaggcgccaugcacaccgcucugacgggggccacagagauccagauguccucuggcaaccuucuguucaccggacaucucaagugcagacugcgcauggacaagcugcaacugaaaggcaugagcuacuccauguguacagggaaguucaaagucgugaaggaaauugccgagacccagcacggaaccaucgucauucgggugcaguaugagggcgaugggagccccugcaaaauccccuuugaaauuauggaccucgagaagagacauguucugggacgccugaucacagugaacccuaucgucacggaaaaggauucuccggugaauauugaggcugaacccccuuucggcgacuccuacaucauuaucgggguugagcccggccagcucaaacugaacugguuuaagaaaggaagcucuauuggccaaauguucgagaccacaaugagaggggcgaagagaauggccauccuuggagauaccgcuugggacuuuggcagccuugggggaguguucacauccauuggcaaagcccuccaccaggucuuuggggccaucuacggcgcugccuucucuggagugagcuggaccaugaagauccugauuggcgugaucauuacguggaucgggaugaacucccgcagcacaucucuguccguuacccuuguccucgugggaauugugacccuguaucugggcgucauggugcaggcguga

SEQ ID NO: 2083 - RNA, 2043 nt, Artificial Sequence
  derived and/or modified CDS sequence (opt5) from DENV-2 CYD2-T__SSopt-prME(R188L)
augaagcggaaaaagagcgccggcaugaucauuaugcugauccccaccgugauggcuuuccaccucacaacgagaaacggggagccucauaugauugucucccgccaggaaaaaggaaagucucugcuuuuuaaaaccgaggacggcguuaauaugugcacacugauggccauggaucucggggaacugugugaggacaccaucacauacaagugcccgcuucugagacaaaacgaacccgaggauauugacuguuggugcaauagcaccuccacaugggugaccuauggaacguguaccacaaugggcgagcaccggcgcgaaaagagaucuguggcgcucgucccucauguggggaugggacuggagacccggacagaaaccuggaugagcuccgagggcgcuuggaaacacguucagcgcaucgagacguggauccugagacaucccggcuucacaaugauggccgccauucucgcuuacaccaucgggacaacccacuuucagcgggcccugauuuucauccuucugaccgcugugacaccuucuaugacgaugcgcugcauuggaaugagcaacagagauuuugucgaaggcguguccgggggaagcuggguugacaucgugcucgagcacggcucuugugucaccacaauggccaagaauaaacccacccuggauuucgaacuuauuaagacagaggcgaaacagccugccacccugcggaaguauugcaucgaagcuaagcucacgaacacaaccaccgagucccgcuguccgacacaaggggagcccagccugaaugaggaacaggacaaaagauuugugugcaagcauucuaugguggaucggggauggggcaacggcugugggcuguucggaaaaggcgggaucguuaccugcgccauguuucgcugcaagaaaaauauggaaggaaaggucgugcagccugagaaccucgaauacacaauugugaucacgccccacuccggcgaggagcaugcugucgggaaugacaccggaaaacacggcaaggaaauuaagaucacaccucagagcucuauuaccgaggccgaacugacaggcuaugggaccgugacgauggaguguagcccccuuaccggacuggauuucaacgaaaugguucuccugcaaauggagaauaaagcguggcuugugcacagacagugguuucuggaccucccgcugccuuggcugcccggcgccgauacacagggguccaacuggauccagaaggagacccucgucacauucaaaaauccucaugcuaagaaacaagacgugguugugcugggaucccaggaaggcgccaugcacaccgcucuuacgggggccacagagauccagaugucuagcggcaaccugcucuuuaccggacaucugaagugccggcuuagaauggacaagcugcaacucaaaggcauguccuacagcauguguacagggaaguucaaagucgugaaggaaauugccgagacccagcacggaaccaucgucauucgcgugcaguaugagggcgaugggucucccugcaaaauccccuucgaaauuauggaccuggagaagcggcauguucugggaagacucaucacagugaacccuaucgucacggaaaaggauuccccggugaauauugaggcugaacccccuuuuggcgacagcuacaucauuaucgggguugagcccggccagcugaaacuuaacugguucaagaaaggaucuagcauuggccaaauguuugagaccacaaugcgcggggcgaagcggauggccauccugggagauaccgcuugggacuucggcucccucgggggaguguuuacaucuauuggcaaagcccugcaccaggucuucggggccaucuacggcgcugccuuuagcggaguguccuggaccaugaagauccugauuggcgugaucauuacguggaucgggaugaauagcagaucuacaucccuuagcguuacccucguccuggugggaauugugacccuguaucucggcgucauggugcaggcguga

SEQ ID NO: 2084 - RNA, 2043 nt, Artificial Sequence
  derived and/or modified CDS sequence (opt5) from DENV-2 CYD2-T__SSopt-pr(D104A)MEdelstem_TM,(F108S)-JEV
augaagcggaaaaagagcgccggcaugaucauuaugcugauccccaccgugauggcuuuccaccucacaacgagaaacggggagccucauaugauugucucccgccaggaaaaaggaaagucucugcuuuuuaaaaccgaggacggcguuaauaugugcacacugauggccauggaucucggggaacugugugaggacaccaucacauacaagugcccgcuucugagacaaaacgaacccgaggauauugacuguuggugcaauagcaccuccacaugggugaccuauggaacguguaccacaaugggcgagcaccggcgcgcgaagagaucuguggcucucgucccucauguggggaugggacuggaaacccggacagagaccuggaugagcuccgaaggcgccuggaaacacguucagcgcaucgagacguggauccugagacaucccggcuucacaaugauggccgcuauucucgccuacaccaucgggacaacccacuuucagcgggcucugauuuucauccuucugaccgccgugacaccuucuaugacgaugcgcugcauuggaaugagcaacagagauuuugucgagggcguguccgggggaagcuggguugacaucgugcucgaacacggcucuugugucaccacaauggcgaagaauaaacccacccuggauuucgagcuuauuaagacagaagccaaacagccugcuacccugcggaaguauugcaucgaggccaagcucacgaacacaaccaccgaaucccgcuguccgacacaaggggagcccagccugaaugaggaacaggacaaaagauuugugugcaagcauucuaugguggaucggggauggggcaacggcugugggcuguccggaaaaggcgggaucguuaccugcgcuauguuccgcugcaagaaaaauauggagggaaaggucgugcagccugaaaaccucgaguacacaauugugaucacgccccacagcggcgaggaacaugccgucgggaaugacaccggaaaacacggcaaggagauuaagaucacaccucagucuuccauuaccgaagcggagcugacaggcuaugggaccgugacgauggaauguagccccagaaccggacuugauuuuaacgagaugguucugcuccaaauggaaaauaaagccuggcuggugcaccggcagugguuccuugaccugccgcucccuuggcugcccggcgcugauacacagggguccaacuggauccagaaggagacccuggucacauuuaaaaauccucaugccaagaaacaagacgugguugugcucggaucucaggagggcgcuaugcacaccgcccugacgggggccacagaaauccagaugagcuccggcaaccuucuguucaccggacaucucaagugcagacugcgcauggacaaacuucaacugaagggcaugagcuacucuauguguacagggaaguuuaaagucgugaaggagauugcugaaacccagcacggaaccaucgucauucgggugcaguaugagggcgaugggucccccugcaaaauccccuucgagauuauggaccucgaaaagagacauguucugggacgccugaucacagugaacccuaucgucacggagaaggauagcccggugaauauugaagcggagcccccuuucggcgacucuuacaucauuaucgggguugaacccggccagcucaaacugaacugguuuaagaaaggaagcacccuuggcaaggccuucuccacaacccugaaaggggcucaacggcucgccgcccugggagauacagcuugggacuuuggcucuauugggggaguguucaauagcaucggcagagccguccaccagguguuugggggcgcguuccgcacccuguuuggaggcauguccuggauuacgcaggggcuuaugggagcucuccugcuguggaugggcgugaacgcccgggauagaagcaucgcccucgcuuuccuggccacagggggaguucuugucuuucuggcuaccaaugugcacgccuga

SEQ ID NO: 2085 - RNA, 2043 nt, Artificial Sequence
  derived and/or modified CDS sequence (opt5) from DENV-2 CYD2-T__SSopt-prMEdelstem_TM,(H261N)-JEV
augaagcggaaaaagagcgccggcaugaucauuaugcugauccccaccgugauggcuuuccaccucacaacgagaaacggggagccucauaugauugucucccgccaggaaaaaggaaagucucugcuuuuuaaaaccgaggacggcguuaauaugugcacacugauggccauggaucucggggaacugugugaggacaccaucacauacaagugcccgcuucugagacaaaacgaacccgaggauauugacuguuggugcaauagcaccuccacaugggugaccuauggaacguguaccacaaugggcgagcaccggcgcgaaaagagaucuguggcgcucgucccucauguggggaugggacuggagacccggacagaaaccuggaugagcuccgagggcgcuuggaaacacguucagcgcaucgagacguggauccugagacaucccggcuucacaaugauggccgccauucucgcuuacaccaucgggacaacccacuuucagcgggcccugauuuucauccuucugaccgcugugacaccuucuaugacgaugcgcugcauuggaaugagcaacagagauuuugucgaaggcguguccgggggaagcuggguugacaucgugcucgagcacggcucuugugucaccacaauggccaagaauaaacccacccuggauuucgaacuuauuaagacagaggcgaaacagccugccacccugcggaaguauugcaucgaagcuaagcucacgaacacaaccaccgagucccgcuguccgacacaaggggagcccagccugaaugaggaacaggacaaaagauuugugugcaagcauucuaugguggaucggggauggggcaacggcugugggcuguucggaaaaggcgggaucguuaccugcgccauguuucgcugcaagaaaaauauggaaggaaaggucgugcagccugagaaccucgaauacacaauugugaucacgccccacuccggcgaggagcaugcugucgggaaugacaccggaaaacacggcaaggaaauuaagaucacaccucagagcucuauuaccgaggccgaacugacaggcuaugggaccgugacgauggaguguucccccagaaccggacuugauuucaacgaaaugguucugcuccaaauggagaauaaagcguggcuggugcaccggcagugguuucuugaccugccgcucccuuggcugcccggcgccgauacacaggggagcaacuggauccagaaggagacccuggucacauucaaaaauccucaugcuaagaaacaagacgugguugugcucggaucccaggaaggcgccaugaacaccgcucugacgggggccacagagauccagaugucuagcggcaaccuucuguuuaccggacaccucaagugcagacugcgcauggacaaacuucaacugaagggcauguccuacagcauguguacagggaaguucaaagucgugaaggaaauugccgagacccagcauggaaccaucgucauucgggugcaguaugagggcgaugggucucccugcaaaauccccuucgaaauuauggaccucgagaagagacacguucugggacgccugaucacagugaauccuaucgucacggaaaaggauuccccggugaacauugaggcugaacccccuuuuggcgacagcuacaucauuaucgggguugagcccggccagcucaaacugaauugguucaagaaaggaucuacccuuggcaaggcguuuagcacaacccugaaaggggcccaacggcucgcugcccugggagauacagccugggacuucggcuccauugggggaguguuuaacucuaucggcagagcuguccaucagguguucgggggcgccuuucgcacccuguucggaggcaugagcuggauuacgcaggggcuuaugggagcgcuccugcuguggaugggcgugaaugcucgggauagauccaucgcccucgccuuucuggcuacagggggaguucuugucuuccuggccaccaacgugcacgcuuga

SEQ ID NO: 2086 - RNA, 2043 nt, Artificial Sequence
  derived and/or modified CDS sequence (opt5) from DENV-2 CYD2-T__SSopt-prMEdelstem_TM,(R188L,A267T)-JEV
augaagcggaaaaagagcgccggcaugaucauuaugcugauccccaccgugauggcuuuccaccucacaacgagaaacggggagccucauaugauugucucccgccaggaaaaaggaaagucucugcuuuuuaaaaccgaggacggcguuaauaugugcacacugauggccauggaucucggggaacugugugaggacaccaucacauacaagugcccgcuucugagacaaaacgaacccgaggauauugacuguuggugcaauagcaccuccacaugggugaccuauggaacguguaccacaaugggcgagcaccggcgcgaaaagagaucuguggcgcucgucccucauguggggaugggacuggagacccggacagaaaccuggaugagcuccgagggcgcuuggaaacacguucagcgcaucgagacguggauccugagacaucccggcuucacaaugauggccgccauucucgcuuacaccaucgggacaacccacuuucagcgggcccugauuuucauccuucugaccgcugugacaccuucuaugacgaugcgcugcauuggaaugagcaacagagauuuugucgaaggcguguccgggggaagcuggguugacaucgugcucgagcacggcucuugugucaccacaauggccaagaauaaacccacccuggauuucgaacuuauuaagacagaggcgaaacagccugccacccugcggaaguauugcaucgaagcuaagcucacgaacacaaccaccgagucccgcuguccgacacaaggggagcccagccugaaugaggaacaggacaaaagauuugugugcaagcauucuaugguggaucggggauggggcaacggcugugggcuguucggaaaaggcgggaucguuaccugcgccauguuucgcugcaagaaaaauauggaaggaaaggucgugcagccugagaaccucgaauacacaauugugaucacgccccacuccggcgaggagcaugcugucgggaaugacaccggaaaacacggcaaggaaauuaagaucacaccucagagcucuauuaccgaggccgaacugacaggcuaugggaccgugacgauggaguguagcccccuuaccggacuggauuucaacgaaaugguucuccugcaaauggagaauaaagcguggcuugugcacagacagugguuucuggaccucccgcugccuuggcugcccggcgccgauacacagggguccaacuggauccagaaggagacccucgucacauucaaaaauccucaugcuaagaaacaagacgugguugugcugggaucccaggaaggcgccaugcacaccgcucuuacggggacaaccgagauccagaugucuagcggcaaccugcucuuuacaggacaucugaagugccggcuuagaauggacaagcugcaacucaaaggcauguccuacagcauguguaccgggaaguucaaagucgugaaggaaauugccgagacccagcacggaacaaucgucauucgcgugcaguaugagggcgaugggucucccugcaaaauccccuucgaaauuauggaccuggagaagcggcauguucugggaagacucaucacggugaacccuaucgucaccgaaaaggauuccccggugaauauugaggccgaacccccuuuuggcgacagcuacaucauuaucgggguugagcccggccagcugaaacuuaacugguucaagaaaggaucuacacugggcaaggcuuuuagcaccacacucaaaggggcgcaacgccuggccgcucugggagauaccgccugggacuucggcuccauugggggaguguuuaauucuaucggccgggccguccaccagguguucgggggcgcuuuuagaacgcuuuucggaggcaugagcuggauuacacaggggcucaugggagcccugcugcucuggaugggcgugaacgcgcgcgaucgguccaucgcucuggccuuucuugccaccgggggaguucuggucuuccucgcuaccaaugugcacgccuga

SEQ ID NO: 2087 - RNA, 297 nt, Artificial Sequence
  derived and/or modified CDS sequence (opt5) from DENV-4 Consensus__C
augaaccagagaaagaaagugguccggcccccuuucaauaugcugaagcgcgagagaaaccggguuagcaccccgcaaggccucgugaaacgcuuuuccacagggcuguucucuggaaagggcccccuuagaauggugcuggccuuuaucacguuccuccggguccugagcauuccucccaccgcugggauccuuaaacgcuggggacagcugaagaagaauaaagccauuaagauccucauuggcuuuagaaaagaaaucgggcggaugcugaacauccugaauggacgcaagaga

SEQ ID NO: 2088 - RNA, 339 nt, Artificial Sequence
  derived and/or modified CDS sequence (opt5) from DENV-4 Consensus__C-SSc
augaaccagagaaagaaagugguccggcccccuuucaauaugcugaagcgcgagagaaaccggguuagcaccccgcaaggccucgugaaacgcuuuuccacagggcuguucucuggaaagggcccccuuagaauggugcuggccuuuaucacguuccuccggguccugagcauuccucccaccgcugggauccuuaaacgcuggggacagcugaagaagaauaaagccauuaagauccucauuggcuuuagaaaagaaaucgggcggaugcugaacauccugaauggacgcaagagauccacaauuacccuccugugccuuaucccuacagugauggcg

SEQ ID NO: 2089 - RNA, 273 nt, Artificial Sequence
  derived and/or modified CDS sequence (opt5) from DENV-4 Consensus__pr
uuccaccugagcaccagagacggcgagccccucaugaucguggccaagcaugaacgggggcgcccucugcuuuuuaaaacaacggagggaauuaacaagugcacccugaucgcuauggaucucggcgaaaugugugaggacacagucaccuacaaaugcccgcugcuuguuaauacagaacccgaggauauugacuguuggugcaaccugaccuccacaugggugauguaugggaccuguacgcagucuggagagagacggcgcgaaaagaga

SEQ ID NO: 2090 - RNA, 225 nt, Artificial Sequence
  derived and/or modified CDS sequence (opt5) from DENV-4 Consensus__M
agcguggcccugacaccccacuccggcauggggcucgagaccagagcugaaacguggaugucuagcgagggagccuggaagcaugcgcagcgggucgaauccuggauccugcgcaacccuggcuucgcccuucuggcuggguuuauggccuacaugauuggacaaaccggcauccagagaacaguuuucuuugugcucaugaugcugguggcuccgucuuauggg

SEQ ID NO: 2091 - RNA, 498 nt, Artificial Sequence
  derived and/or modified CDS sequence (opt5) from DENV-4 Consensus__prM
uuccaccugagcaccagagacggcgagccccucaugaucguggccaagcaugaacgggggcgcccucugcuuuuuaaaacaacggagggaauuaacaagugcacccugaucgcuauggaucucggcgaaaugugugaggacacagucaccuacaaaugcccgcugcuuguuaauacagaacccgaggauauugacuguuggugcaaccugaccuccacaugggugauguaugggaccuguacgcagucuggagagagacggcgcgaaaagagaagcguggcccucaccccucacuccggcauggggcuggagacacgggcggaaaccuggaugucuagcgagggagcuuggaaacaugcccaacgcgucgaguccuggauccugagaaaucccggcuucgcccuccuggcuggcuuuauggccuacaugauugggcagacaggaauccagcggaccguguucuuuguucuuaugaugcugguggcuccuucuuauggc

SEQ ID NO: 2092 - RNA, 1485 nt, Artificial Sequence
  derived and/or modified CDS sequence (opt5) from DENV-4 Consensus__E
augagaugcgugggcgucgggaaccgggacuucguugagggagugagcggcggggccuggguggaucugguccucgaacacggaggcugugugaccacaauggcucaggggaagcccacgcuggacuuugagcuuaccaaaacaaccgccaaggaaguugcgcugcuccgcacauacugcaucgaggcuuccauuucuaauaucaccacagccaccagauguccuacgcaaggagaaccguaucugaaagaggagcaggaucagcaguacauuugccggcgcgacguggucgauagaggcuggggcaacggguguggacuuuucggcaaagggggagugguuaccugcgccaaguuuagcuguuccggcaagaucacagggaaucuggugcaaauugaaaaccucgaguauaccgucguggugacaguccauaauggagacacccacgcuguuggcaacgauacgucuaaucauggcgugacagccaccaucacaccccggagcccuuccguggaagucaagcugcccgacuacggggagcugacccucgauugcgagccucgcucuggaaucgacuucaacgaaaugauucugaugaaaaugaagaaaaagaccuggcuugugcacaaacagugguuucuggaucucccccugccuuggacagcuggcgccgacacgagcgagguucauuggaauuauaaggaaagaauggugaccuucaaggucccgcacgcgaaacggcaggaugugacaguucuugggucccaggagggagccaugcacagcgcucuggccggcgcuaccgaaguggacucuggggacggaaaccauauguuugccggccaccucaaguguaaaguccgcauggagaagcugagaaucaaaggcauguccuacacaaugugcagcgggaaguucucuauugauaaagagauggcggaaacccaacauggaacgacaguggucaaggugaaguaugagggcgccggggcucccuguaaaguuccuaucgaaauucgggacgugaauaaggagaaagucgugggacgcguuaucuccagcacaccccuggccgaaaacaccaauucugugaccaacauugagcucgagccucccuuuggcgauuccuacaucgucaucggggugggcaauagcgcucugacccuucacugguucagaaagggauccucuauuggcaaaauguuugaaagcacauaccgcggggccaagcggauggccauccugggagagacggcuugggacuucggcuccguugggggacucuuuaccagccugggcaaggcggugcaccaggucuucgggucuguguauacaaccauguucggcggaguguccuggaugauuagaauccuuauuggcuuucugguccucuggaucgggacaaacagccggaacaccucuauggccaugacgugcaucgcugugggaggcauuacccuguuccugggguuuacaguucaggcc

SEQ ID NO: 2093 - RNA, 1983 nt, Artificial Sequence
  derived and/or modified CDS sequence (opt5) from DENV-4 Consensus__prME
uuccaccugagcaccagagacggcgagccccucaugaucguggccaagcaugaacgggggcgcccucugcuuuuuaaaacaacggagggaauuaacaagugcacccugaucgcuauggaucucggcgaaaugugugaggacacagucaccuacaaaugcccgcugcuuguuaauacagaacccgaggauauugacuguuggugcaaccugaccuccacaugggugauguaugggaccuguacgcagucuggagagagacggcgcgaaaagagaagcguggcccucaccccucacuccggcauggggcuggagacacgggcggaaaccuggaugucuagcgagggagcuuggaaacaugcccaacgcgucgaguccuggauccugagaaaucccggcuucgcccuccuggcuggcuuuauggccuacaugauugggcagacaggaauccagcggaccguguucuuuguucuuaugaugcugguggcuccuucuuauggcaugcgcugcgucggggugggaaacagagauuucguugaaggcgugagcgggggagccugggucgaccucgugcuggagcacggcggcugugugacgacaauggcgcaggggaagcccacccuugauuuugaacugacaaagaccaccgccaaagaggucgcucuccugcggacauacugcaucgaagccuccauuagcaauaucacgaccgcuacacgcuguccuacccaaggagagccguaucugaaggaggaacaggaccagcaguacauuugcagacgggauguuguggaccgcggcugggggaacggauguggccucuucgggaaaggaggcguggucacaugcgccaaguuuucuugcuccggcaaaaucaccgggaaucuggugcaaauugagaaccuugaauauacgguuguggucacagugcauaauggagauacccacgcgguuggcaacgacaccagcaaucacggggugacagccaccaucacacccagaucuccuuccgucgaggugaagcugcccgauuacggagaacucacgcuggacugugagccucggagcggcauugacuucaacgagaugauccuuaugaagaugaaaaagaaaaccuggcugguccauaagcagugguuucucgaucugccccugccguggacagcuggggccgacaccucugaagugcacuggaauuacaaagagagaaugguuacauucaaggugccucaugcuaaacgccaggaugucaccgugcucggcucccaggaaggagccaugcacagcgcccuggcuggcgcgacggagguugacuccggggauggaaaccacauguuugccggccaucuuaagugcaaggugcggauggaaaaacugagaaucaaggggaugucuuauaccauguguagcggaaaauucuccauugacaaggagauggcugagacacaacacggcaccacagucgugaaagugaaguacgaaggggccggcgcccccugcaagguuccuaucgagauucgcgaugucaauaaagaaaagguggugggacgggucaucagcucuacgccccucgcugagaacaccaacuccgugacaaauauugagcuggaacccccuuucggcgacagcuauaucguuaucggggugggaaacucugcccuuacccugcauugguuuagaaaaggcagcuccauugggaagauguucgagucuacauaccgcggagcgaaacggauggcuauccucggcgaaaccgccugggauuuugggagcgucggcggacuguucaccucccugggcaaggccgugcaccagguuuuugggagcguguauacaacgauguucggaggcgucucuuggaugauuagaauccucauuggguuucuggugcuuuggaucggaaccaauucccgcaacacaagcauggcuaugaccuguaucgccguuggcgggauuacacuguuccucggcuuuaccgugcaggcu

SEQ ID NO: 2094 - RNA, 2025 nt, Artificial Sequence
  derived and/or modified CDS sequence (opt5) from DENV-4 Consensus__SSc-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggaaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaagaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccacaccccuggccgagaacaccaacagcguuaccaauaucgagcucgaaccuccguucggcgacucuuauauugugaucggggucggaaacagcgcgcugacccugcauugguuuagaaaaggcuccucuauugggaagauguucgagagcacauaccgcggagcuaaacggauggccauccucggcgaaacggccugggauuuuggguccgugggcggacuguucaccagccuuggcaaggcuguucaccagguguuugggucugucuauacaaccauguucggaggcguguccuggaugauuagaauccugaucggguuucucguucuguggauuggaacaaauagccgcaacaccucuauggccaugacgugcaucgcugugggcgggauuacacuguuccuuggcuuuaccguccaggcc

SEQ ID NO: 2095 - RNA, 2322 nt, Artificial Sequence
  derived and/or modified CDS sequence (opt5) from DENV-4 Consensus__C-prME
augaaccagagaaagaaagugguccggcccccuuucaauaugcugaagcgcgagagaaaccggguuagcaccccgcaaggccucgugaaacgcuuuuccacagggcuguucucuggaaagggcccccuuagaauggugcuggccuuuaucacguuccuccggguccugagcauuccucccaccgcugggauccuuaaacgcuggggacagcugaagaagaauaaagccauuaagauccucauuggcuuuagaaaagaaaucgggcggaugcugaacauccugaauggacgcaagagauccacaauuacccuccugugccuuaucccuacagugauggcguuccaccugucuacccgggacggcgagccccucaugauuguugcuaaacaugaacgcggcagaccucugcuuuuuaagacaaccgaggggaucaacaaguguacgcugauugccauggaucucggagaaaugugcgaggacaccgugacauacaaauguccgcugcuggucaauaccgagcccgaagauaucgacugcugguguaaccucacaagcaccugggugauguauggcacgugcacacaguccggggagcggcgcagagaaaagcggucuguugcccugaccccucacagcggaaugggccuugagacaagagcugagaccuggauguccagcgaaggggccuggaaacaugcucagcgcguggagucuuggauucugcggaaucccggauucgcccuccuggcgggcuuuauggccuacaugaucggccaaaccgggauccagagaacagucuucuuugugcuuaugaugcugguggcuccuuccuauggaaugcgcugugucggcguugggaaccgggauuucguggaaggagugagcggcggggccugggucgaccucgugcuggagcacggaggcugcguuacgaccauggcucagggcaagcccacacuggauuuugaacucaccaaaacaaccgccaaggagguggcgcugcuuagaacguacuguauugaggccucuaucuccaauauuacaaccgcuacccgcugcccgacacagggggaaccuuaucugaaagaggaacaagaccagcaguacaucugucggagagaugucguggaccgcggauggggcaacgggugcggacucuucggcaaagggggcguugugaccugcgccaaguucagcuguucuggaaagauuacaggcaaucugguccagaucgagaaccuugaauauacgguggucgugaccguucauaauggggauacacacgcugugggaaacgacaccuccaaccacggcgucacagccaccaucacgccccggagcccuuccguggagguuaagcugcccgauuacggggagcucacccuggacugcgaacccagaucuggaauugacuuuaaugagaugauccugaugaaaaugaagaaaaagacauggcucgugcauaagcaaugguuccuggaucuuccucugccguggaccgccggcgcugacacaagcgaaguccacuggaacuacaaagagcgcauggugaccuuuaaggugccccaugcgaaacggcaggauguuacgguccucgggucccaggaaggcgccaugcacagcgcucuggccggagccacagagguggacucuggcgaugggaaucacauguucgcuggacaucugaaguguaaagugagaauggagaaacuucggauuaagggcauguccuauaccaugugcagcgggaaguuuucuaucgacaaggaaauggccgagacacaacacggaaccaccgucgugaaaguuaaguacgaaggcgcgggggcuccuuguaaagugcccauugagauccgcgaugucaacaaggagaaggugguuggcagagugaucagcuccacaccucucgccgaaaauacgaacucugucaccaauauugagcuggaacccccguucggagacagcuauaucgugauuggcguugggaacuccgcccugacacuccauugguuucggaaaggaagcucuaucggcaagauguucgaguccaccuacagaggggcuaaacgcauggccauucugggagaaacagcuugggauuuuggcagcgucgggggccuuuucaccucucugggaaaggccgugcaccagguguuuggcuccguguauacgacaauguucgggggagucagcuggaugauccggauucucaucggcuuucugguucuguggaucgggaccaauuccagaaacaccucuauggcgaugacaugcauugccgugggaggcaucacccuuuuccucggcuucacagugcaggcu

SEQ ID NO: 2096 - RNA, 45 nt, Artificial Sequence
  derived and/or modified CDS sequence (opt5) from DENV-4 Consensus__SSc
augagcaccaucacacugcucugccugauucccacggugauggcc

SEQ ID NO: 2097 - RNA, 57 nt, Artificial Sequence
  derived and/or modified CDS sequence (opt5) from DENV-4 Consensus__SSopt
augaagagaaagaaaagcaccaucacacugcucugccugauucccacggugauggcc

SEQ ID NO: 2098 - RNA, 57 nt, Artificial Sequence; identical to SEQ ID NO: 1794
  derived and/or modified CDS sequence (opt5) from DENV-4 Consensus__SSm

SEQ ID NO: 2099 - RNA, 1488 nt, Artificial Sequence
  derived and/or modified CDS sequence (opt5) from DENV-4 Consensus__E
augagaugcgugggcgucgggaaccgggacuucguugagggagugagcggcggggccuggguggaucugguccucgaacacggaggcugugugaccacaauggcucaggggaagcccacgcuggacuuugagcuuaccaaaacaaccgccaaggaaguugcgcugcuccgcacauacugcaucgaggcuuccauuucuaauaucaccacagccaccagauguccuacgcaaggagaaccguaucugaaagaggagcaggaucagcaguacauuugccggcgcgacguggucgauagaggcuggggcaacggguguggacuuuucggcaaagggggagugguuaccugcgccaaguuuagcuguuccggcaagaucacagggaaucuggugcaaauugaaaaccucgaguauaccgucguggugacaguccauaauggagacacccacgcuguuggcaacgauacgucuaaucauggcgugacagccaccaucacaccccggagcccuuccguggaagucaagcugcccgacuacggggagcugacccucgauugcgagccucgcucuggaaucgacuucaacgaaaugauucugaugaaaaugaagaaaaagaccuggcuugugcacaaacagugguuucuggaucucccccugccuuggacagcuggcgccgacacgagcgagguucauuggaauuauaaggaaagaauggugaccuucaaggucccgcacgcgaaacggcaggaugugacaguucuugggucccaggagggagccaugcacagcgcucuggccggcgcuaccgaaguggacucuggggacggaaaccauauguuugccggccaccucaaguguaaaguccgcauggagaagcugagaaucaaaggcauguccuacacaaugugcagcgggaaguucucuauugauaaagagauggcggaaacccaacauggaacgacaguggucaaggugaaguaugagggcgccggggcucccuguaaaguuccuaucgaaauucgggacgugaauaaggagaaagucgugggacgcguuaucuccagcacaccccuggccgaaaacaccaauucugugaccaacauugagcucgagccucccuuuggcgauuccuacaucgucaucggggugggcaauagcgcucugacccuucacugguucagaaagggauccucuauuggcaaaauguuugaaagcacauaccgcggggccaagcggauggccauccugggagagacggcuugggacuucggcuccguugggggacucuuuaccagccugggcaaggcggugcaccaggucuucgggucuguguauacaaccauguucggcggaguguccuggaugauuagaauccuuauuggcuuucugguccucuggaucgggacaaacagccggaacaccucuauggccaugacgugcaucgcugugggaggcauuacccuguuccugggguuuacaguucaggccuga

SEQ ID NO: 2100 - RNA, 1182 nt, Artificial Sequence
  derived and/or modified CDS sequence (opt5) from DENV-4 Consensus__EdelTM-variant (aa1-394)
augagaugcgugggcgucgggaaccgggacuucguugagggagugagcggcggggccuggguggaucugguccucgaacacggaggcugugugaccacaauggcucaggggaagcccacgcuggacuuugagcuuaccaaaacaaccgccaaggaaguugcgcugcuccgcacauacugcaucgaggcuuccauuucuaauaucaccacagccaccagauguccuacgcaaggagaaccguaucugaaagaggagcaggaucagcaguacauuugccggcgcgacguggucgauagaggcuggggcaacggguguggacuuuucggcaaagggggagugguuaccugcgccaaguuuagcuguuccggcaagaucacagggaaucuggugcaaauugaaaaccucgaguauaccgucguggugacaguccauaauggagacacccacgcuguuggcaacgauacgucuaaucauggcgugacagccaccaucacaccccggagcccuuccguggaagucaagcugcccgacuacggggagcugacccucgauugcgagccucgcucuggaaucgacuucaacgaaaugauucugaugaaaaugaagaaaaagaccuggcuugugcacaaacagugguuucuggaucucccccugccuuggacagcuggcgccgacacgagcgagguucauuggaauuauaaggaaagaauggugaccuucaaggucccgcacgcgaaacggcaggaugugacaguucuugggucccaggagggagccaugcacagcgcucuggccggcgcuaccgaaguggacucuggggacggaaaccauauguuugccggccaccucaaguguaaaguccgcauggagaagcugagaaucaaaggcauguccuacacaaugugcagcgggaaguucucuauugauaaagagauggcggaaacccaacauggaacgacaguggucaaggugaaguaugagggcgccggggcucccuguaaaguuccuaucgaaauucgggacgugaauaaggagaaagucgugggacgcguuaucuccagcacaccccuggccgaaaacaccaauucugugaccaacauugagcucgagccucccuuuggcgauuccuacaucgucaucggggugggcaauagcgcucugacccuucacugguucagaaag

SEQ ID NO: 2101 - RNA, 1272 nt, Artificial Sequence
  derived and/or modified CDS sequence (opt5) from DENV-4 Consensus__EdelTM-variant (aa1-424)
augagaugcgugggcgucgggaaccgggacuucguugagggagugagcggcggggccuggguggaucugguccucgaacacggaggcugugugaccacaauggcucaggggaagcccacgcuggacuuugagcuuaccaaaacaaccgccaaggaaguugcgcugcuccgcacauacugcaucgaggcuuccauuucuaauaucaccacagccaccagauguccuacgcaaggagaaccguaucugaaagaggagcaggaucagcaguacauuugccggcgcgacguggucgauagaggcuggggcaacggguguggacuuuucggcaaagggggagugguuaccugcgccaaguuuagcuguuccggcaagaucacagggaaucuggugcaaauugaaaaccucgaguauaccgucguggugacaguccauaauggagacacccacgcuguuggcaacgauacgucuaaucauggcgugacagccaccaucacaccccggagcccuuccguggaagucaagcugcccgacuacggggagcugacccucgauugcgagccucgcucuggaaucgacuucaacgaaaugauucugaugaaaaugaagaaaaagaccuggcuugugcacaaacagugguuucuggaucucccccugccuuggacagcuggcgccgacacgagcgagguucauuggaauuauaaggaaagaauggugaccuucaaggucccgcacgcgaaacggcaggaugugacaguucuugggucccaggagggagccaugcacagcgcucuggccggcgcuaccgaaguggacucuggggacggaaaccauauguuugccggccaccucaaguguaaaguccgcauggagaagcugagaaucaaaggcauguccuacacaaugugcagcgggaaguucucuauugauaaagagauggcggaaacccaacauggaacgacaguggucaaggugaaguaugagggcgccggggcucccuguaaaguuccuaucgaaauucgggacgugaauaaggagaaagucgugggacgcguuaucuccagcacaccccuggccgaaaacaccaauucugugaccaacauugagcucgagccucccuuuggcgauuccuacaucgucaucggggugggcaauagcgcucugacccuucacugguucagaaagggauccucuauuggcaaaauguuugaaagcacauaccgcggggccaagcggauggccauccugggagagacggcuugggacuucggcucc

SEQ ID NO: 2102 - RNA, 1266 nt, Artificial Sequence
  derived and/or modified CDS sequence (opt5) from DENV-4 Consensus__EdelTM-variant (aa1-421)
augagaugcgugggcgucgggaaccgggacuucguugagggagugagcggcggggccuggguggaucugguccucgaacacggaggcugugugaccacaauggcucaggggaagcccacgcuggacuuugagcuuaccaaaacaaccgccaaggaaguugcgcugcuccgcacauacugcaucgaggcuuccauuucuaauaucaccacagccaccagauguccuacgcaaggagaaccguaucugaaagaggagcaggaucagcaguacauuugccggcgcgacguggucgauagaggcuggggcaacggguguggacuuuucggcaaagggggagugguuaccugcgccaaguuuagcuguuccggcaagaucacagggaaucuggugcaaauugaaaaccucgaguauaccgucguggugacaguccauaauggagacacccacgcuguuggcaacgauacgucuaaucauggcgugacagccaccaucacaccccggagcccuuccguggaagucaagcugcccgacuacggggagcugacccucgauugcgagccucgcucuggaaucgacuucaacgaaaugauucugaugaaaaugaagaaaaagaccuggcuugugcacaaacagugguuucuggaucucccccugccuuggacagcuggcgccgacacgagcgagguucauuggaauuauaaggaaagaauggugaccuucaaggucccgcacgcgaaacggcaggaugugacaguucuugggucccaggagggagccaugcacagcgcucuggccggcgcuaccgaaguggacucuggggacggaaaccauauguuugccggccaccucaaguguaaaguccgcauggagaagcugagaaucaaaggcauguccuacacaaugugcagcgggaaguucucuauugauaaagagauggcggaaacccaacauggaacgacaguggucaaggugaaguaugagggcgccggggcucccuguaaaguuccuaucgaaauucgggacgugaauaaggagaaagucgugggacgcguuaucuccagcacaccccuggccgaaaacaccaauucugugaccaacauugagcucgagccucccuuuggcgauuccuacaucgucaucggggugggcaauagcgcucugacccuucacugguucagaaagggauccucuauuggcaaaauguuugaaagcacauaccgcggggccaagcggauggccauccugggagagacggcuugggacuga

SEQ ID NO: 2103 - RNA, 2031 nt, Artificial Sequence
  derived and/or modified CDS sequence (opt5) from DENV-4 Consensus__SSc-prME
augagcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggaaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaagaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccacaccccuggccgagaacaccaacagcguuaccaauaucgagcucgaaccuccguucggcgacucuuauauugugaucggggucggaaacagcgcgcugacccugcauugguuuagaaaaggcuccucuauugggaagauguucgagagcacauaccgcggagcuaaacggauggccauccucggcgaaacggccugggauuuuggguccgugggcggacuguucaccagccuuggcaaggcuguucaccagguguuugggucugucuauacaaccauguucggaggcguguccuggaugauuagaauccugaucggguuucucguucuguggauuggaacaaauagccgcaacaccucuauggccaugacgugcaucgcugugggcgggauuacacuguuccuuggcuuuaccguccaggccuga

SEQ ID NO: 2104 - RNA, 2031 nt, Artificial Sequence
  derived and/or modified CDS sequence (opt5) from DENV-4 Consensus__SSc-prME(F108S)
augagcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggaaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguccgggaaaggaggcgucgugacaugcgcgaaguucagcuguucuggcaaaaucaccgggaaucucguucaaauugagaaccuggaauauaccguggucgugacaguucauaauggagauacccacgccgugggcaacgacacauccaaucacggggucacggcuaccaucacaccuagaagccccucuguggaggucaaacuuccugauuacggagaacugacccucgacugcgagccccgguccggcaucgacuuuaacgagaugauucugaugaagaugaagaagaaaacauggcuggugcauaagcagugguuccucgaucugccgcuuccuuggaccgccggggcugacacgagcgaaguucacuggaauuacaaagagagaauggugaccuuuaaggucccccaugccaaacgccaggaugugacaguucugggcucccaggaaggagccaugcacucugcucucgcgggcgccaccgagguggacagcggggauggaaaccacauguucgcuggccaucugaaguguaagguccggauggaaaaacuuagaaucaaggggauguccuauacaaugugcagcggaaaauuuucuauugacaaggagauggccgagacccaacacggcacgacaguggugaaaguuaaguacgaaggggccggcgcuccuuguaagguccccaucgagauucgcgaugugaauaaagaaaagguggucggacgggugaucuccagcacaccccuggccgagaacaccaacucuguuaccaauaucgagcucgaaccuccguucggcgacagcuauauugugaucggggucggaaacuccgcgcugacccugcauugguucagaaaaggcucuagcauugggaagauguuugaguccacauaccgcggagcuaaacggauggccauccucggcgaaacggccugggauuucgggagcgugggcggacuguuuaccucucuuggcaaggcuguucaccagguguucggguccgucuauacaaccauguuuggaggcgugagcuggaugauuagaauccugaucggguuccucguucuguggauuggaacaaauucucgcaacaccuccauggccaugacgugcaucgcugugggcgggauuacacuguuucuuggcuucaccguccaggccuga

SEQ ID NO: 2105 - RNA, 2031 nt, Artificial Sequence
  derived and/or modified CDS sequence (opt5) from DENV-4 Consensus__SSc-prMEdelstem_TM-JEV
augagcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggaaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaagaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccacaccccuggccgagaacaccaacagcguuaccaauaucgagcucgaaccuccguucggcgacucuuauauugugaucggggucggaaacagcgcgcugacccugcauugguuuagaaaaggcuccacacucgggaaggcuuucucuacgacccugaaaggagcccagcgccuugccgcucugggcgauacagccugggacuuugggagcauuggcggaguguucaauuccaucggccgggcuguucaccagguguuugggggagccuucagaacccucuuuggcgggaugagcuggauuacacaaggacugaugggcgcgcugcuucucuggaugggggucaacgcccgcgaucggucuaucgcucuggccuuccuggcuaccggcggagugcucguuuuucuggccacgaaugugcaugcguga

SEQ ID NO: 2106 - RNA, 1332 nt, Artificial Sequence
  derived and/or modified CDS sequence (opt5) from DENV-4 Consensus__SSm-EdelTM
augauccagagaaccguguucuuuguccugaugaugcucguugcccccagcuacggcaugcggugcgugggggugggaaaccgcgacuucgucgagggcguguccgggggagcuuggguugaucuggugcuugaacacggcgggugugucacaacgauggcccaaggaaagccuacccuggacuuugagcucacaaaaaccacagcgaaggaaguggcucugcuuagaaccuauugcauugaggccucuaucagcaauauuacaaccgccacgcgguguccgacccagggcgaacccuaccugaaagaggagcaggaucagcaauauaucugccgcagagacguuguggaucggggcugggggaacggauguggccucuucgggaagggaggcgucgugacaugcgcuaaauuuuccuguucugggaagauuaccggaaaucuggugcagaucgaaaaccuggaguacacagucguugugaccgugcauaauggcgacacgcacgccgucggcaacgauacaagcaaucauggggugaccgcuacaaucaccccucgcucccccucuguugaagugaagcucccugacuauggagagcugacccuugauugcgagcccagaagcggcauugacuucaacgaaaugauccugaugaaaaugaagaaaaagacauggcucguccacaaacagugguuucuggaucuuccucugccguggacggccggggcggacaccuccgaggugcauuggaauuacaaggaacggaugguuacauucaaggugccccacgccaaacgccaggaugucaccgugcucggaagccaagagggcgcuaugcacucugcccuggcuggggccacagaagucgacuccggagacggcaaccauauguuugcgggccaccugaaguguaaagugagaauggagaagcuccggauuaaagggaugagcuauaccaugugcucuggaaaguucuccaucgauaaagagauggccgaaacgcagcauggcacaaccguugugaaggucaaguacgagggggcuggagccccuuguaaagugcccauugaaauccgcgacguuaauaaggagaaaguggucggcagagugauuagcucuaccccucuggcugaaaacacaaauuccgugaccaacaucgagcuugagcccccguuuggggauagcuacaucguuauuggcgucggaaauuccgcccugacacuccacugguuccggaagggcucuagcaucgggaaaauguuugaauccacguaucgcggagccaagagaauggcuauucugggcgagaccgcgugggacuucgggagcuga

SEQ ID NO: 2107 - RNA, 2376 nt, Artificial Sequence
  derived and/or modified CDS sequence (opt5) from DENV-4 Consensus__C-P2A-SSc-prME
augaaccagagaaagaaagugguccggcccccuuucaauaugcugaagcgcgagagaaaccggguuagcaccccgcaaggccucgugaaacgcuuuuccacagggcuguucucuggaaagggcccccuuagaauggugcuggccuuuaucacguuccuccggguccugagcauuccucccaccgcugggauccuuaaacgcuggggacagcugaagaagaauaaagccauuaagauccucauuggcuuuagaaaagaaaucgggcggaugcugaacauccugaauggacgcaagagaaacuucgaccuccugaaacuugcgggcgauguggaguccaauccuggccccucuacaauuacccugcucugccugaucccuacaguuauggcuuuucaccuuagcacccgggacggggaaccgcugaugauuguggccaagcaugagcgcggaagaccccuccuguucaagacaaccgaaggcaucaacaaauguacgcugauugccauggaucucggggagaugugcgaggacaccgucacauacaaguguccucugcuugugaauaccgaacccgaggauaucgacugcugguguaaccugacauccaccuggguuauguauggaacgugcacacagucuggcgaacggcgcagagagaaacggagcguggcucucaccccucacuccgggaugggacuggagacaagagccgaaaccuggaugagcucugagggcgcuuggaagcaugcccagcgcgucgaauccuggauucuucggaaucccggcuuugcgcugcucgccggguucauggcuuacaugaucggacaaaccggcauccagagaacaguguuuuucgugcugaugaugcuggucgccccgagcuaugggaugcgcuguguuggagugggcaaccgggauuuuguggagggggucucuggaggcgcuuggguggaccucguucuggaacacggcgggugcgugacgaccauggcccagggaaaaccuacacuugauuucgagcugaccaagacaaccgcgaaagaggucgcccuccugagaacguacuguauugaggcuuccaucagcaauauuacaaccgccacccgcugccccacacagggcgagccuuaucuuaaggaagaacaagaccagcaguacaucugucggagagaugugguugaccgcggguggggaaacggcugcgggcuguucggcaagggaggcguggugaccugcgcuaaauuuucuuguuccgggaagauuacaggaaaucucguccagaucgaaaaccuggaguauacggucgugguuaccgugcauaacggcgauacacacgccgucgggaaugacaccagcaaccacggagugacagccaccaucacgccccggucccccucuguugaggugaaacugccugacuacggcgaacucacccuggauugcgagccgagaagcgggauugacuucaaugaaaugauccuuaugaagaugaaaaagaagacauggcugguccauaaacaaugguuucucgaucugccccugccuuggaccgcuggcgcggacacauccgaggugcacuggaacuacaaggaacgcauggugaccuucaaaguuccccaugccaagcggcaggaugucacggugcuuggaagccaggagggcgcuaugcacucugcccucgccggggcuacagagguggacuccggagauggcaaucacauguuugccgggcaucugaaauguaaggucagaauggaaaagcugcggauuaaaggaaugagcuauaccaugugcucuggcaaguucagcaucgacaaagagauggcggaaacacaacacgggaccaccgugguuaaggugaaauacgagggcgcuggagccccuuguaagguccccauugagauccgcgaugugaacaaggaaaaaguugugggcagagucaucuccucuacaccgcucgccgagaauacgaacagcgugaccaauauugaacuggagccucccuuuggggacuccuauaucguuauuggagugggcaacagcgcucuuacacugcauugguuccggaaggggucuuccaucggaaaaauguuugaaagcaccuacagaggcgccaagcgcauggcuauucucggggagacagccugggauuucggcucugucggaggccuguuuaccucccuggggaaagcggugcaccagguguucggaagcgucuauacgacaauguuuggcgggguuuccuggaugauccggauucuuaucggauuccucgugcuguggaucggcaccaauucuagaaacaccagcauggccaugacaugcauugcugugggcgggaucacccuguuccucggauuuacaguccaggccuga

SEQ ID NO: 2108 - RNA, 2043 nt, Artificial Sequence
  derived and/or modified CDS sequence (opt5) from DENV-4 Consensus__SSopt-prME(F108S)
augaagcggaaaaagagcaccaucacacugcucugccugauucccacggugauggccuuccaccuuuccaccagagacggcgagccucugaugaucgucgcuaaacaugaacgcgggagaccgcuccuguuuaagacaaccgagggaauuaacaaauguacacuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagcggcgcagagaaaagcgguccgucgcgcucacaccccacucuggcauggggcuggagacccgcgcugaaacguggaugagcuccgagggagccuggaaacaugcccaaagaguggagucuuggauccuucggaauccuggcuucgcucugcucgccggcuuuauggcuuacaugaucgggcagacaggcauucagcgcaccguuuucuuugugcugaugaugcuugucgcccccagcuauggaaugagauguguggggguuggaaaccgggauuucguggaaggcgucuccgggggagcguggguggaccuggugcucgagcacggcggcugcgucacaaccauggcccaggggaagccuacccuggauuuugaacugacaaaaacgaccgcuaaggagguugcccuccugcgcacauacuguaucgaagcuagcauuucuaauaucaccacagccaccagaugcccgacgcaaggagagcccuaucuuaaagaggaacaggaccagcaguacauuugucggcgcgaugugguggacagaggcugggggaacggaugcggccuguccgggaagggaggcgucgugacaugcgcgaaguucagcuguucuggcaaaaucaccgggaaucucguucaaauugagaaccuggaauauaccguggucgugacaguucauaauggagauacccacgccgugggcaacgacacauccaaucacggggucacggcuaccaucacaccucggagccccucuguggaggucaaacuuccugauuacggagaacugacccucgacugcgagcccagauccggcaucgacuuuaacgagaugauucugaugaagaugaagaaaaagacauggcuggugcauaaacagugguuccucgaucugccgcuuccuuggaccgccggggcugacacgagcgaaguucacuggaauuacaaggagcgcauggugaccuuuaaggucccccaugccaaacggcaggaugugacaguucugggcucccaggaaggagccaugcacucugcucucgcgggcgccaccgagguggacagcggggauggaaaccacauguucgcuggccaucugaaguguaaagucagaauggaaaaacuucgcaucaaggggauguccuauacaaugugcagcggaaaguuuucuauugacaaggagauggccgagacccaacacggcacgacaguggugaaaguuaaguacgaaggggccggcgcuccuuguaaaguccccaucgagauucgggaugugaauaaggaaaaaguggucggaagagugaucuccagcacaccccuggccgagaacaccaacucuguuaccaauaucgagcucgaaccuccguucggcgacagcuauauugugaucggggucggaaacuccgcgcugacccugcauugguuccgcaagggcucuagcauugggaagauguuugaguccacauaccggggagcuaaaagaauggccauccucggcgaaacggccugggauuucgggagcgugggcggacuguuuaccucucuuggcaaggcuguucaccagguguucggguccgucuauacaaccauguuuggaggcgugagcuggaugauucgcauccugaucggguuccucguucuguggauuggaacaaauucucggaacaccuccauggccaugacgugcaucgcugugggcgggauuacacuguuucuuggcuucaccguccaggccuga

SEQ ID NO: 2109 - RNA, 2043 nt, Artificial Sequence
  derived and/or modified CDS sequence (opt5) from DENV-4 Consensus__SSopt-prME(V96H)
augaagcggaaaaagagcaccaucacacugcucugccugauucccacggugauggccuuccaccuuuccaccagagacggcgagccucugaugaucgucgcuaaacaugaacgcgggagaccgcuccuguuuaagacaaccgagggaauuaacaaauguacacuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagcggcgcagagaaaagcgguccgucgcgcucacaccccacucuggcauggggcuggagacccgcgcugaaacguggaugagcuccgagggagccuggaaacaugcccaaagaguggagucuuggauccuucggaauccuggcuucgcucugcucgccggcuuuauggcuuacaugaucgggcagacaggcauucagcgcaccguuuucuuugugcugaugaugcuugucgcccccagcuauggaaugagauguguggggguuggaaaccgggauuucguggaaggcgucuccgggggagcguggguggaccuggugcucgagcacggcggcugcgucacaaccauggcccaggggaagccuacccuggauuuugaacugacaaaaacgaccgcuaaggagguugcccuccugcgcacauacuguaucgaagcuagcauuucuaauaucaccacagccaccagaugcccgacgcaaggagagcccuaucuuaaagaggaacaggaccagcaguacauuugucggcgcgaucauguggacagaggcugggggaacggaugcggccuguucgggaagggaggcguggucacaugcgcgaaguuuuccuguagcggcaaaaucaccgggaaucucgugcaaauugagaaccuggaauauaccguuguggucacagugcacaauggagauacccacgccguuggcaacgacacaucuaaucauggggugacggcuaccaucacaccucggucccccagcgucgaggugaaacuuccugauuacggagaacugacccucgacugcgagcccagaucuggcaucgacuucaacgagaugauucugaugaagaugaagaaaaagacauggcugguccacaaacagugguuucucgaucugccgcuuccuuggaccgccggggcugacacguccgaagugcauuggaauuacaaggagcgcaugguuaccuucaaggugccccacgccaaacggcaggaugucacagugcugggcagccaggaaggagccaugcacuccgcucucgcgggcgccaccgagguugacucuggggauggaaaccauauguuugcuggccaccugaaguguaaagugagaauggaaaaacuucgcaucaaggggaugagcuauacaaugugcuccggaaaguucagcauugacaaggagauggccgagacccaacauggcacgacagucgugaaagugaaguacgaaggggccggcgcuccuuguaaaguucccaucgagauucgggaugucaauaaggaaaaaguggugggaagagucaucucuuccacaccccuggccgagaacaccaacagcgugaccaauaucgagcucgaaccuccguucggcgacucuuauauuguuaucggggugggaaacagcgcgcugacccugcacugguuucgcaagggcuccucuauugggaagauguucgagagcacauaccggggagcuaaaagaauggccauccucggcgaaacggccugggauuuuggguccgucggcggacuguucaccagccuuggcaaggcugugcaucagguuuuugggucuguguauacaaccauguucggaggcgucuccuggaugauucgcauccugaucggguuucucgugcuguggauuggaacaaauagccggaacaccucuauggccaugacgugcaucgcuguuggcgggauuacacuguuccuuggcuuuaccgugcaggccuga

SEQ ID NO: 2110 - RNA, 2043 nt, Artificial Sequence
  derived and/or modified CDS sequence (opt5) from DENV-4 Consensus__SSopt-prME(E186F)
augaagcggaaaaagagcaccaucacacugcucugccugauucccacggugauggccuuccaccuuuccaccagagacggcgagccucugaugaucgucgcuaaacaugaacgcgggagaccgcuccuguuuaagacaaccgagggaauuaacaaauguacacuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagcggcgcagagaaaagcgguccgucgcgcucacaccccacucuggcauggggcuggagacccgcgcugaaacguggaugagcuccgagggagccuggaaacaugcccaaagaguggagucuuggauccuucggaauccuggcuucgcucugcucgccggcuuuauggcuuacaugaucgggcagacaggcauucagcgcaccguuuucuuugugcugaugaugcuugucgcccccagcuauggaaugagauguguggggguuggaaaccgggauuucguggaaggcgucuccgggggagcguggguggaccuggugcucgagcacggcggcugcgucacaaccauggcccaggggaagccuacccuggauuuugaacugacaaaaacgaccgcuaaggagguugcccuccugcgcacauacuguaucgaagcuagcauuucuaauaucaccacagccaccagaugcccgacgcaaggagagcccuaucuuaaagaggaacaggaccagcaguacauuugucggcgcgaugugguggacagaggcugggggaacggaugcggccuguucgggaagggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccucggucccccagcguggaggucaaacuuccugauuacggagaacugacccucgacugcuuccccagaucuggcaucgacuuuaacgagaugauucugaugaagaugaagaaaaagacauggcuggugcauaaacagugguuccucgaucugccgcuuccuuggaccgccggggcugacacguccgagguucacuggaauuacaaggaacgcauggugaccuuuaaggucccccaugccaaacggcaggaugugacaguucugggcagccaggagggagccaugcacuccgcucucgcgggcgccaccgaaguggacucuggggauggaaaccacauguucgcuggccaucugaaguguaaagucagaauggagaaacuucgcaucaaggggaugagcuauacaaugugcuccggaaaguucagcauugacaaggaaauggccgagacccaacacggcacgacaguggugaaaguuaaguacgagggggccggcgcuccuuguaaaguccccaucgaaauucgggaugugaauaaggagaaaguggucggaagagugaucucuuccacaccccuggccgaaaacaccaacagcguuaccaauaucgagcucgagccuccguuuggcgacucuuauauugugaucggggucggaaacagcgcgcugacccugcauugguuccgcaagggcuccucuauugggaagauguuugaaagcacauaccggggagcuaaaagaauggccauccucggcgagacggccugggauuucggguccgugggcggacuguuuaccagccuuggcaaggcuguucaccagguguucgggucugucuauacaaccauguuuggaggcguguccuggaugauucgcauccugaucggguuccucguucuguggauuggaacaaauagccggaacaccucuauggccaugacgugcaucgcugugggcgggauuacacuguuucuuggcuucaccguccaggccuga

SEQ ID NO: 2111 - RNA, 2043 nt, Artificial Sequence
  derived and/or modified CDS sequence (opt5) from DENV-4 Consensus__SSopt-prME(R188L)
augaagcggaaaaagagcaccaucacacugcucugccugauucccacggugauggccuuccaccuuuccaccagagacggcgagccucugaugaucgucgcuaaacaugaacgcgggagaccgcuccuguuuaagacaaccgagggaauuaacaaauguacacuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagcggcgcagagaaaagcgguccgucgcgcucacaccccacucuggcauggggcuggagacccgcgcugaaacguggaugagcuccgagggagccuggaaacaugcccaaagaguggagucuuggauccuucggaauccuggcuucgcucugcucgccggcuuuauggcuuacaugaucgggcagacaggcauucagcgcaccguuuucuuugugcugaugaugcuugucgcccccagcuauggaaugagauguguggggguuggaaaccgggauuucguggaaggcgucuccgggggagcguggguggaccuggugcucgagcacggcggcugcgucacaaccauggcccaggggaagccuacccuggauuuugaacugacaaaaacgaccgcuaaggagguugcccuccugcgcacauacuguaucgaagcuagcauuucuaauaucaccacagccaccagaugcccgacgcaaggagagcccuaucuuaaagaggaacaggaccagcaguacauuugucggcgcgaugugguggacagaggcugggggaacggaugcggccuguucgggaagggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccucggucccccagcguggaggucaaacuuccugauuacggagaacugacccucgacugcgagccccugucuggcaucgacuucaacgagaugauucugaugaagaugaagaaaaagacauggcucgugcauaaacagugguuucuggaucuuccgcugccuuggaccgccggggcugacacguccgaaguucacuggaauuacaaggagagaauggugaccuucaaggucccccaugccaaacgccaggaugugacaguucucggcagccaggaaggagccaugcacuccgcucuggcgggcgccaccgagguggacucuggggauggaaaccacauguuugcuggccaucuuaaguguaaaguccggauggaaaagcugagaaucaaagggaugagcuauacaaugugcuccggaaaguucagcauugacaaggagauggccgagacccaacacggcacgacaguggugaaaguuaaguacgaaggggccggcgcuccuuguaaaguccccaucgagauucgcgaugugaauaaggaaaaaguggucggacgggugaucucuuccacaccccucgccgagaacaccaacagcguuaccaauaucgagcuggaaccuccguucggcgacucuuauauugugaucggggucggaaacagcgcgcugacccuccauugguuuagaaagggcuccucuauugggaagauguucgagagcacauaccgcggagcuaaacggauggccauccugggcgaaacggccugggauuuuggguccgugggcggacuuuucaccagccugggcaaggcuguucaccagguguuugggucugucuauacaaccauguucggaggcguguccuggaugauuagaauccucaucggguuucugguucuguggauuggaacaaauagccgcaacaccucuauggccaugacgugcaucgcugugggcgggauuacacuuuuccucggcuuuaccguccaggccuga

SEQ ID NO: 2112 - RNA, 2043 nt, Artificial Sequence
  derived and/or modified CDS sequence (opt5) from DENV-4 Consensus__SSopt-pr(D104A)MEdelstem_TM,(F108S)-JEV
augaagcggaaaaagagcaccaucacacugcucugccugauucccacggugauggccuuccaccuuuccaccagagacggcgagccucugaugaucgucgcuaaacaugaacgcgggagaccgcuccuguuuaagacaaccgagggaauuaacaaauguacacuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagcggcgcagagcgaagcgguccgucgcucucacaccccacucuggcauggggcuggaaacccgcgccgagacguggaugagcuccgaaggagccuggaaacaugcucaaagaguggagucuuggauccuucggaauccuggcuucgcccugcucgcuggcuuuauggccuacaugaucgggcagacaggcauucagcgcaccguuuucuuugugcugaugaugcuugucgcgcccagcuauggaaugagauguguggggguuggaaaccgggauuucguggagggcgucuccgggggagccuggguggaccuggugcucgaacacggcggcugcgucacaaccauggcucaggggaagccuacccuggauuuugagcugacaaaaacgaccgccaaggaaguugcucuccugcgcacauacuguaucgaggccagcauuucuaauaucaccacagcgaccagaugcccgacgcaaggagaacccuaucuuaaagaggagcaggaccagcaguacauuugucggcgcgaugugguggacagaggcugggggaacggaugcggccuguccgggaagggaggcgucgugacaugcgccaaguucagcuguucuggcaaaaucaccgggaaucucguucaaauugaaaaccuggaguauaccguggucgugacaguucauaauggagauacccacgcugugggcaacgacacauccaaucacggggucacggccaccaucacaccucggagccccucuguggaagucaaacuuccugauuacggagagcugacccucgacugcgaacccagauccggcaucgacuuuaacgagaugauucugaugaagaugaagaaaaagacauggcuggugcauaaacagugguuccucgaucugccgcuuccuuggaccgcuggggccgacacgagcgagguucacuggaauuacaaggaacgcauggugaccuuuaaggucccccaugccaaacggcaggaugugacaguucugggcucccaggagggagcuaugcacucugcgcucgccggcgcuaccgaaguggacagcggggauggaaaccacauguucgccggccaucugaaguguaaagucagaauggagaaacuucgcaucaaggggauguccuauacaaugugcagcggaaaguuuucuauugacaaggaaauggccgagacccaacacggcacgacaguggugaaaguuaaguacgagggggcuggcgccccuuguaaaguccccaucgaaauucgggaugugaauaaggagaaaguggucggaagagugaucuccagcacaccccuggcggaaaacaccaacucuguuaccaauaucgagcucgagccuccguucggcgacagcuauauugugaucggggucggaaacuccgcucugacccugcauugguuccgcaagggcucuacacucgggaaggccuuuagcacgacccugaaaggagcccagcggcuugcugcccugggcgauacagcuugggacuucggguccauuggcggaguguuuaauagcaucggcagagccguucaccagguguucgggggagcguuucgcacccucuucggcgggaugucuuggauuacacaaggacugaugggcgcccugcuucucuggaugggggucaacgcucgggauagauccaucgcccuggcuuuucuggccaccggcggagugcucguuuuccuggcgacgaaugugcaugccuga

SEQ ID NO: 2113 - RNA, 2043 nt, Artificial Sequence
  derived and/or modified CDS sequence (opt5) from DENV-4 Consensus__SSopt-prMEdelstem_TM,(H261N)-JEV
augaagcggaaaaagagcaccaucacacugcucugccugauucccacggugauggccuuccaccuuuccaccagagacggcgagccucugaugaucgucgcuaaacaugaacgcgggagaccgcuccuguuuaagacaaccgagggaauuaacaaauguacacuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagcggcgcagagaaaagcgguccgucgcgcucacaccccacucuggcauggggcuggagacccgcgcugaaacguggaugagcuccgagggagccuggaaacaugcccaaagaguggagucuuggauccuucggaauccuggcuucgcucugcucgccggcuuuauggcuuacaugaucgggcagacaggcauucagcgcaccguuuucuuugugcugaugaugcuugucgcccccagcuauggaaugagauguguggggguuggaaaccgggauuucguggaaggcgucuccgggggagcguggguggaccuggugcucgagcacggcggcugcgucacaaccauggcccaggggaagccuacccuggauuuugaacugacaaaaacgaccgcuaaggagguugcccuccugcgcacauacuguaucgaagcuagcauuucuaauaucaccacagccaccagaugcccgacgcaaggagagcccuaucuuaaagaggaacaggaccagcaguacauuugucggcgcgaugugguggacagaggcugggggaacggaugcggccuguucgggaagggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccucggucccccagcguggaggucaaacuuccugauuacggagaacugacccucgacugcgagcccagaucuggcaucgacuucaacgagaugauucugaugaagaugaagaaaaagacauggcuggugcauaaacagugguuucucgaucugccgcuuccuuggaccgccggggcugacacguccgaaguucacuggaauuacaaggagcgcauggugaccuucaaggucccccaugccaaacggcaggaugugacaguucugggcagccaggaaggagccaugaacuccgcucucgcgggcgccaccgagguggacucuggggauggaaaucacauguuugcuggccaccugaaguguaaagucagaauggaaaaacuucgcaucaaggggaugagcuauacaaugugcuccggaaaguucagcauugacaaggagauggccgagacccaacauggcacgacaguggugaaaguuaaguacgaaggggccggcgcuccuuguaaaguccccaucgagauucgggaugugaacaaggaaaaaguggucggaagagugaucucuuccacaccccuggccgagaacaccaauagcguuaccaacaucgagcucgaaccuccguucggcgacucuuauauugugaucggggucggaaauagcgcgcugacccugcacugguuucgcaagggcuccacacucgggaaggcuuucucuacgacccugaaaggagcccagcggcuugccgcucugggcgauacagccugggacuuugggagcauuggcggaguguucaacuccaucggcagagcuguucaucagguguuugggggagccuuccgcacccucuuuggcgggaugagcuggauuacacaaggacugaugggcgcgcugcuucucuggaugggggucaaugcccgggauagaucuaucgcucuggccuuccuggcuaccggcggagugcucguuuuucuggccacgaacgugcacgcguga

SEQ ID NO: 2114 - RNA, 2043 nt, Artificial Sequence
  derived and/or modified CDS sequence (opt5) from DENV-4 Consensus__SSopt-prMEdelstem_TM,(R188L,A267T)-JEV
augaagcggaaaaagagcaccaucacacugcucugccugauucccacggugauggccuuccaccuuuccaccagagacggcgagccucugaugaucgucgcuaaacaugaacgcgggagaccgcuccuguuuaagacaaccgagggaauuaacaaauguacacuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagcggcgcagagaaaagcgguccgucgcgcucacaccccacucuggcauggggcuggagacccgcgcugaaacguggaugagcuccgagggagccuggaaacaugcccaaagaguggagucuuggauccuucggaauccuggcuucgcucugcucgccggcuuuauggcuuacaugaucgggcagacaggcauucagcgcaccguuuucuuugugcugaugaugcuugucgcccccagcuauggaaugagauguguggggguuggaaaccgggauuucguggaaggcgucuccgggggagcguggguggaccuggugcucgagcacggcggcugcgucacaaccauggcccaggggaagccuacccuggauuuugaacugacaaaaacgaccgcuaaggagguugcccuccugcgcacauacuguaucgaagcuagcauuucuaauaucaccacagccaccagaugcccgacgcaaggagagcccuaucuuaaagaggaacaggaccagcaguacauuugucggcgcgaugugguggacagaggcugggggaacggaugcggccuguucgggaagggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccucggucccccagcguggaggucaaacuuccugauuacggagaacugacccucgacugcgagccccugucuggcaucgacuucaacgagaugauucugaugaagaugaagaaaaagacauggcucgugcauaaacagugguuucuggaucuuccgcugccuuggaccgccggggcugacacguccgaaguucacuggaauuacaaggagagaauggugaccuucaaggucccccaugccaaacgccaggaugugacaguucucggcagccaggaaggagccaugcacuccgcucuggcgggcaccacagagguggacucuggggauggaaaccacauguuugccggccaucuuaaguguaaaguccggauggaaaagcugagaaucaaagggaugagcuauaccaugugcuccggaaaguucagcauugacaaggagauggcugagacgcaacacggcacaaccguggugaaaguuaaguacgaaggggccggcgccccuuguaaaguccccaucgagauucgcgaugugaauaaggaaaaaguggucggacgggugaucucuuccacaccccucgcugagaacaccaacagcguuaccaauaucgagcuggaaccuccguucggcgacucuuauauugugaucggggucggaaacagcgcccugacacuccauugguuuagaaagggcuccacgcuggggaaggcguucucuaccacacuuaaaggagcucagcgccuggccgcccucggcgauaccgcuugggacuuugggagcauuggcggaguguucaauuccaucggccgggccguucaccagguguuugggggagcuuucagaacacuguuuggcgggaugagcuggauuacccaaggacugaugggcgcccuucuccuguggaugggggucaacgcgcgcgaucggucuaucgcccuggcuuuccucgccacgggcggagugcugguuuuucuugcuacaaaugugcaugccuga

SEQ ID NO: 2115 - RNA, 300 nt, Artificial Sequence
  derived and/or modified CDS sequence (opt5) from DENV-3 Consensus__C
augaacaaucagagaaagaaaaccggcaagcccagcaucaacaugcugaaacgggugcgcaauagagucuccacagggucucaacucgccaagcgguucagcaaaggacugcuuaacggccaggggccuaugaagcugguuauggcuuuuauugccuuccuccgcuuucuggcgaucccgcccacggcuggagugcuugccagauggggcaccuucaagaaauccggggccauuaaggugcugaaaggauuuaagaaagagaucucuaauaugcucagcauuaucaacaagcggaagaaa

SEQ ID NO: 2116 - RNA, 342 nt, Artificial Sequence
  derived and/or modified CDS sequence (opt5) from DENV-3 Consensus__C-SSc
augaacaaucagagaaagaaaaccggcaagcccagcaucaacaugcugaaacgggugcgcaauagagucuccacagggucucaacucgccaagcgguucagcaaaggacugcuuaacggccaggggccuaugaagcugguuauggcuuuuauugccuuccuccgcuuucuggcgaucccgcccacggcuggagugcuugccagauggggcaccuucaagaaauccggggccauuaaggugcugaaaggauuuaagaaagagaucucuaauaugcucagcauuaucaacaagcggaagaaaacaucccugugccugaugaugauccucccugcugcccuggcu

SEQ ID NO: 2117 - RNA, 273 nt, Artificial Sequence
  derived and/or modified CDS sequence (opt5) from DENV-3 Consensus__pr
uuccaccugaccagcagagacggcgagccccggaugaucguggggaagaacgaacgcggaaaaucccuccuguuuaagacagccucuggcauuaauaugugcacgcuuaucgcuauggaucugggggagaugugugacgauaccgucacauacaaaugcccucauauuaccgaaguugagccggaagacaucgauuguuggugcaaccucacaagcaccugggugacauauggaaccuguaaucaggccggcgagcacagacgggacaagcgc

SEQ ID NO: 2118 - RNA, 225 nt, Artificial Sequence
  derived and/or modified CDS sequence (opt5) from DENV-3 Consensus__M
agcguggcccuggcuccccacgucggcauggggcucgacaccagaacacagacguggauguccgccgagggagcguggcggcaaguugaaaagguggagaccugggcucugcgccauccuggcuucacaauccuugcccuguuucucgcccacuacauugggaccucucugacacagaaaguggucaucuucauucuucugaugcucgugaccccgagcaugaca

SEQ ID NO: 2119 - RNA, 498 nt, Artificial Sequence
  derived and/or modified CDS sequence (opt5) from DENV-3 Consensus__prM
uuccaccugaccagcagagacggcgagccccggaugaucguggggaagaacgaacgcggaaaaucccuccuguuuaagacagccucuggcauuaauaugugcacgcuuaucgcuauggaucugggggagaugugugacgauaccgucacauacaaaugcccucauauuaccgaaguugagccggaagacaucgauuguuggugcaaccucacaagcaccugggugacauauggaaccuguaaucaggccggcgagcacagacgggacaagcgcuccguggcgcuggcuccccaugucgggaugggacuugauacgagaacccaaacauggaugucugccgagggcgccuggcgccagguggaaaaaguugagaccugggcucugcggcacccuggcuucacaauucucgcccuguuucuggcucauuacaucgggaccagccucacgcagaagguggucaucuucauucugcuuaugcuggugacacccuccaugacc

SEQ ID NO: 2120 - RNA, 1479 nt, Artificial Sequence
  derived and/or modified CDS sequence (opt5) from DENV-3 Consensus__E
augagaugcgugggcgucgggaaccgggacuucguugagggacugagcggcgccaccuggguggaugugguccucgaacacgggggaugugugacaacgauggcuaagaauaaacccacccuggacaucgagcuucagaagacagaagccacccaacuggcgacacuccgcaaacugugcauugagggcaagaucaccaacauuacaaccgauuccagauguccuacgcagggggaagcuacccuuccggaggagcaggaccagaauuacguuugcaaacauacauauguggaucggggauggggcaacggcugugggcuguuuggaaagggcucucucgugaccugcgccaaguuccaaugucuggaacccaucgaggggaaagucguucaguacgaaaaucugaaguauacagugauuaucaccguccacacgggagaccagcaucaggugggcaacgagacacaaggggugaccgccgagaucacaccucaggcuagcaccaccgaagccauucuccccgaguacggaacacugggccuugaaugcuccccucgcacgggccuggauuuuaaugagaugauccuccugaccaugaaaaacaaggcuuggaugguccacagacagugguucuuugaccuuccccugccuuggacaucuggggccaccacagaaaccccgacguggaaucggaaagagcuccugguuacauucaagaacgcgcaugccaagaaacaggagguggugguccugggaagccaagaaggcgcuaugcacaccgcccucaccggggcuacagagauucaaaauuccggaggcaccucuaucuuugccgggcaccugaagugucgccuuaaaauggauaagcuggaacucaaaggaaugagcuaugcgaugugcacaaacacguucgugcugaagaaagagguuuccgaaacccagcauggcacaauucuuaucaagguggaguacaagggcgaggacguccccuguaaaauuccuuuuagcaccgaagaugggcagggaaaggcccacaauggcagacugaucacagcuaaccccgugguuaccaaaaaggaggaaccugugaauaucgaggccgaacccccguucggggagucuaacauugucaucggaauuggcgacaacgcucucaaaaucaauugguauaagaagggguccagcauuggcaaaauguuugaggccacggcccggggagcucgcagaauggcgauccugggcgauaccgccugggacuucgggucugugggaggcguccugaacucccucgggaagauggugcaucagaucuuuggaagcgcuuacacagcccuguucucuggcguuuccugggugaugaaaauugggaucggcguccuucugaccuggauuggacucaauagcaagaacacauccaugucuuucagcugcaucgccauuggcaucaucacccuguaccuuggggcugugguucaggcc

SEQ ID NO: 2121 - RNA, 1977 nt, Artificial Sequence
  derived and/or modified CDS sequence (opt5) from DENV-3 Consensus__prME
uuccaccugaccagcagagacggcgagccccggaugaucguggggaagaacgaacgcggaaaaucccuccuguuuaagacagccucuggcauuaauaugugcacgcuuaucgcuauggaucugggggagaugugugacgauaccgucacauacaaaugcccucauauuaccgaaguugagccggaagacaucgauuguuggugcaaccucacaagcaccugggugacauauggaaccuguaaucaggccggcgagcacagacgggacaagcgcuccguggcgcuggcuccccaugucgggaugggacuugauacgagaacccaaacauggaugucugccgagggcgccuggcgccagguggaaaaaguugagaccugggcucugcggcacccuggcuucacaauucucgcccuguuucuggcucauuacaucgggaccagccucacgcagaagguggucaucuucauucugcuuaugcuggugacacccuccaugaccaugagaugcguuggagugggcaaccgggacuuugucgaagggcucucuggagccacauggguggaugugguccuggagcacggcggguguguuaccaccauggcgaagaauaaaccuacacuugacaucgagcugcagaagacggaagccacccaacucgcuacacugcgcaaacugugcauugagggaaagaucaccaacauuacaaccgauagcagaugucccacgcagggcgaagccacacucccugaggaacaggaccagaauuaugugugcaaacacaccuacguggaucggggcugggggaacggauguggccuguucgggaagggaucccuugugaccugcgcuaaguuucaaugccuggagccgaucgagggcaaagugguucaguaugaaaaucucaaguacacagugauuaucaccguccauacaggggaccagcaccaggugggaaacgagacgcaaggcguuaccgccgaaaucacaccccaggcgagcaccacagaggccauucugccugaauauggcacccuugggcuggaguguucuccccgcacgggacucgacuucaaugagaugauccugcugaccaugaaaaacaaggcuuggauggugcauagacagugguuuuucgaucucccucugcccuggacauccggcgccaccacagaaaccccgacguggaaucggaaagagcuucuggucacauuuaagaacgcucacgccaaaaagcaagaaguggucgugcucgggagccaggagggagccaugcacaccgcucugacaggcgcgaccgaaauucaaaauucugggggcaccuccaucuucgccggacaucuuaagugccgccugaaaauggacaagcucgagcugaaaggcaugagcuacgcuauguguacaaacacguuuguucugaagaaagaggugucugaaacccagcacgggacaauucucaucaaggucgaguacaagggagaagaugugccuugcaaaauccccuucuccaccgaggacggccaggggaaggcccauaacggaagacugauuacagccaauccuguugugaccaaaaaggaggaacccgucaacaucgaggcugaacccccuuucggcgagagcaauauugugaucgggauuggcgauaacgcccuuaaaaucaauugguauaagaagggauccucuaucggcaaaauguuugaagcgacggcuagaggggcccggcgcauggccauucugggagacacagcuugggauuucggcagcgucgggggaguucucaacucccugggcaagaugguccaccagaucuuugggagcgccuacaccgcucuguucucuggcguguccugggugaugaaaauuggaaucggcguccuucucaccuggauugggcugaauagcaagaacacaucuaugagcuuuuccuguaucgccauuggaaucaucacccuguaucucggcgcggugguucaggcc

SEQ ID NO: 2122 - RNA, 2019 nt, Artificial Sequence
  derived and/or modified CDS sequence (opt5) from DENV-3 Consensus__SSc-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcgccagguggaaaaaguugagacaugggcccuccggcaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaggggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggcccggcgcauggcuauccuuggagacaccgccugggauuucggcuccguugggggagugcucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcu

SEQ ID NO: 2123 - RNA, 1056 nt, Artificial Sequence
  derived and/or modified CDS sequence (opt5) from DENV-3 Consensus__NS1
gacaugggcugcgugaucaacuggaaggggaaagagcugaaguguggaagcggcauuuucgucaccaaugaaguucacacauggacggagcaguacaaauuucaagccgauucccccaagagacucgcuaccgccaucgcgggggcuugggaaaacggagugugcggcauucggucuacaacccgcauggagaaucugcuuuggaaacagaucgccaacgaacugaauuauauucucugggagaacaauaucaagcugacaguggucgugggggacaucauuggaguucuugagcagggcaagagaacccugacaccucagccgauggaacucaaauacagcuggaagaccuggggcaaagccaagaucgugacggcugagacccaaaacuccucuuucauuaucgaugggcccaauacaccugaaugucccagcgucucccgggccuggaacgugugggagguugaggacuauggauuuggcguguucaccacaaauauuuggcugaaacugcgcgaagucuacacccagcucugcgaucauagacugaugucugcugccgugaaggacgagcgggcggugcacgccgauaugggguauuggaucgaaagccagaagaacggauccuggaaacuugagaaggcuagccugauugaagucaaaacguguacauggccuaagucucauacccucugguccaauggcguucuggagagcgacaugaucauccccaaaucucuugccgggccuauuucccagcacaaccaucgcccgggauaccacacacaaaccgcuggccccuggcaccugggcaagcucgagcuggauuuuaauuauugcgaagggaccacaguggugaucacggagaacuguggaaccagaggcccuagccugcggacaaccacagucucugggaaacucauucaugaauggugcugucgcuccugcacccugcccccucuuagauacaugggagaggacggcuguugguacgggauggaaauccggcccauuagcgagaaggaggaaaacauggugaagucccugguuucugcc

SEQ ID NO: 2124 - RNA, 1857 nt, Artificial Sequence
  derived and/or modified CDS sequence (opt5) from DENV-3 Consensus__NS3
agcggcgugcugugggacguccccuccccuccggagacccagaaggccgaacucgaggaagggguuuacagaaucaaacaacagggaauuuucggcaagacacaggugggggugggaguccagaaagagggcguguuucacacgauguggcauguuacccgcggggcugugcugacauauaacggaaagcggcuugaacccaauugggccucugucaaaaaggaucugaucagcuacggcggcggguggagacucuccgcgcaauggcagaagggagaggaggugcagguuauugcuguggaaccuggcaaaaaccccaagaauuuccagaccaugccugggacauuucaaaccacaaccggagagaucggcgccauugcccuggacuucaaacccgggacgucuggaagcccuaucaucaaccgggaaggcaaggucgugggccuuuaugggaauggaguggucaccaaaaacggcggguacguuuccggaauugcucagacaaaugccgagccggauggccccaccccugagcuggaagaggaaauguuuaagaagcgcaaccucacaaucauggaccugcaccccgggucuggaaaaaccagaaaguaucugccugcuauugugcgggaggccaucaaacgcagacuccggacgcugauucuugcgcccacacgcguggucgccgcugaaauggaggaggcccugaagggccucccgaucagauaccagaccacagcuaccaaaagcgaacauaccggccgggagauuguggaucugaugugccacgccacauucacgaugcgccuucuguccccuguuagagugcccaauuauaaccucaucaucauggacgaagcgcauuuuaccgauccugccagcauugcugcccggggguacaucucuacacgcgucggaaugggcgaggcugccgccauuuucaugaccgcuacaccucccgggaccgcggacgccuuuccccaguccaaugcuccgauccaagaugaagagagagacauucccgagcggagcuggaacucuggaaaugaauggaucacggauuucgccggcaagacagugugguuuguuccuuccaucaaagccgggaacgacauugcuaauugucugagaaagaacggcaagaaagugauccagcugagccgcaagaccuucgauaccgaguaccagaaaacaaagcucaacgacugggacuuugucgugaccacagauauuucugaaaugggagccaauuucaaagcggaccgggucaucgaucccagacgcugccugaagccugugauucuuacggacggccccgagcggguuauccuggcugggccgaugccugugaccgccgccuccgcugcccaaagacgcggacgggucggcagaaacccccagaaggaaaaugaucaguauaucuucacagggcagccucucaacaaugacgaggaucacgcucacuggaccgaggccaaaaugcugcuugacaacauuaauacacccgaaggaaucauuccugcgcuguuugagcccgaacgcgaaaagagcgccgcuaucgauggcgaguaccggcucaaaggggaguccagaaagaccuucguggagcugaugcgccggggcgaccugccgguuuggcucgcccauaaaguggcuucugaaggaauuaaguauacggauagaaagugguguuuugacggccaacggaacaaucagauccuggaggaaaacauggacgucgagauuuggaccaaagagggggaaaagaaaaagcugcgcccuagauggcuugaugcccggacauacagcgacccccucgcgcugaaagaguucaaggaauuugccgcuggaagaaag

SEQ ID NO: 2125 - RNA, 2319 nt, Artificial Sequence
  derived and/or modified CDS sequence (opt5) from DENV-3 Consensus__C-prME
augaacaaucagagaaagaaaaccggcaagcccagcaucaacaugcugaaacgggugcgcaauagagucuccacagggucucaacucgccaagcgguucagcaaaggacugcuuaacggccaggggccuaugaagcugguuauggcuuuuauugccuuccuccgcuuucuggcgaucccgcccacggcuggagugcuugccagauggggcaccuucaagaaauccggggccauuaaggugcugaaaggauuuaagaaagagaucucuaauaugcucagcauuaucaacaagcggaagaaaacaucccugugccugaugaugauccucccugcugcccuggcuuuccaccuuaccucucgcgacggcgaacccagaaugauugucggcaagaaugagcgggggaaaagccugcucuuuaagacagccuccggaaucaacauguguacccugauugcgauggaucuuggcgaaaugugcgacgauacagugaccuacaaauguccucauaucacggagguugaacccgaggacauugauugcugguguaaucugaccagcacaugggugaccuaugggacaugcaaccaggccggagagcaccgcagagacaagcggucugucgcucucgccccucaugugggcauggggcuggauacccgcacgcagacauggauguccgcugaaggagccuggagacaaguugagaaaguggaaaccugggcgcugcggcacccgggcuucacaauccucgcccuguuucuugcucauuacauuggcaccagccugacccagaaggucgugaucuucauccuccugaugcuugugacacccucuaugacgaugcgcugugucgggguuggaaauagagacuuuguggagggccuguccggggccaccuggguggaugucgugcucgagcacggaggcugcguuacaaccauggcuaagaacaaaccuacacuggacauugaacugcagaagaccgaggccacgcagcucgccacacugcggaaacuuuguaucgaagggaagauuaccaauaucaccacagauagcagaugccccacccaaggagaggcuacacugccugaagaacaggaccagaacuauguguguaaacacacguacgucgaucgcggcuggggcaaugggugcggacucuucggcaaggggucucuggugaccugcgcgaaguuucagugucuugagcccauugaaggaaaaguugugcaauaugagaaccugaaguacacagucaucaucaccgugcauacaggcgaccagcaccaggucgggaacgaaacccaaggcgugacggccgagauuaccccgcaggcuuccacaaccgaagccauccucccugaguauggaacacugggccuggagugcagcccccggaccgggcucgacuucaaugaaaugauucugcuuacgaugaaaaacaaggccuggaugguucauagacagugguucuuugaucugccucuccccuggacauccggagcuaccacagagacccccaccuggaaucgcaaagaacugcuggugacauucaagaacgcccacgcgaagaaacaggaggucgugguucuuggcucucaagaaggggcuaugcacacggcccucaccggagccacagagauccagaauagcggcgggaccuccauuuuugcuggccaucugaagugucggcugaaaauggacaagcucgagcugaaaggaaugagcuacgccaugugcacaaacaccuucgugcuuaagaaggaagucucugagacgcagcacggcacaauccugaucaaaguggaauacaagggggaggaugugccuuguaaaauuccguuuuccaccgaggacggacagggcaaggcucauaaugggagacucaucaccgccaaccccguugucaccaaaaaggaggagccugugaauauugaagcggagcccccuuucggagaaagcaacaucgugauuggcaucggggauaaugcccugaaaauuaacugguauaagaagggcucuagcaucggaaaaauguuugaggcuacagcccgcggcgcucggagaauggccauccugggggacacagcgugggauuucggauccgucggcggggugcuuaauucucucggaaagaugguucaccaaauuuuuggcagcgccuacacggcucuguucuccggggugagcugggucaugaaaaucggcauuggagugcugcucaccuggaucggccugaacucuaagaauacauccaugagcuuuucuugcauugccaucgggaucauuacccuuuaucugggagcuguugugcaggcc

SEQ ID NO: 2126 - RNA, 45 nt, Artificial Sequence
  derived and/or modified CDS sequence (opt5) from DENV-3 Consensus__SSc
augaccagccugugccucaugaugauccugcccgccgcucuugcc

SEQ ID NO: 2127 - RNA, 57 nt, Artificial Sequence
  derived and/or modified CDS sequence (opt5) from DENV-3 Consensus__SSopt
augaagagaaagaaaaccagccugugccucaugaugauccugcccgccgcucuugcc

SEQ ID NO: 2128 - RNA, 57 nt, Artificial Sequence
  derived and/or modified CDS sequence (opt5) from DENV-3 Consensus__SSm
augacccagaagguggucaucuucauucugcucaugcugguuacacccagcaugacg

SEQ ID NO: 2129 - RNA, 1482 nt, Artificial Sequence
  derived and/or modified CDS sequence (opt5) from DENV-3 Consensus__E
augagaugcgugggcgucgggaaccgggacuucguugagggacugagcggcgccaccuggguggaugugguccucgaacacgggggaugugugacaacgauggcuaagaauaaacccacccuggacaucgagcuucagaagacagaagccacccaacuggcgacacuccgcaaacugugcauugagggcaagaucaccaacauuacaaccgauuccagauguccuacgcagggggaagcuacccuuccggaggagcaggaccagaauuacguuugcaaacauacauauguggaucggggauggggcaacggcugugggcuguuuggaaagggcucucucgugaccugcgccaaguuccaaugucuggaacccaucgaggggaaagucguucaguacgaaaaucugaaguauacagugauuaucaccguccacacgggagaccagcaucaggugggcaacgagacacaaggggugaccgccgagaucacaccucaggcuagcaccaccgaagccauucuccccgaguacggaacacugggccuugaaugcuccccucgcacgggccuggauuuuaaugagaugauccuccugaccaugaaaaacaaggcuuggaugguccacagacagugguucuuugaccuuccccugccuuggacaucuggggccaccacagaaaccccgacguggaaucggaaagagcuccugguuacauucaagaacgcgcaugccaagaaacaggagguggugguccugggaagccaagaaggcgcuaugcacaccgcccucaccggggcuacagagauucaaaauuccggaggcaccucuaucuuugccgggcaccugaagugucgccuuaaaauggauaagcuggaacucaaaggaaugagcuaugcgaugugcacaaacacguucgugcugaagaaagagguuuccgaaacccagcauggcacaauucuuaucaagguggaguacaagggcgaggacguccccuguaaaauuccuuuuagcaccgaagaugggcagggaaaggcccacaauggcagacugaucacagcuaaccccgugguuaccaaaaaggaggaaccugugaauaucgaggccgaacccccguucggggagucuaacauugucaucggaauuggcgacaacgcucucaaaaucaauugguauaagaagggguccagcauuggcaaaauguuugaggccacggcccggggagcucgcagaauggcgauccugggcgauaccgccugggacuucgggucugugggaggcguccugaacucccucgggaagauggugcaucagaucuuuggaagcgcuuacacagcccuguucucuggcguuuccugggugaugaaaauugggaucggcguccuucugaccuggauuggacucaauagcaagaacacauccaugucuuucagcugcaucgccauuggcaucaucacccuguaccuuggggcugugguucaggccuga

SEQ ID NO: 2130 - RNA, 1176 nt, Artificial Sequence
  derived and/or modified CDS sequence (opt5) from DENV-3 Consensus__EdelTM-variant (aa1-392)
augagaugcgugggcgucgggaaccgggacuucguugagggacugagcggcgccaccuggguggaugugguccucgaacacgggggaugugugacaacgauggcuaagaauaaacccacccuggacaucgagcuucagaagacagaagccacccaacuggcgacacuccgcaaacugugcauugagggcaagaucaccaacauuacaaccgauuccagauguccuacgcagggggaagcuacccuuccggaggagcaggaccagaauuacguuugcaaacauacauauguggaucggggauggggcaacggcugugggcuguuuggaaagggcucucucgugaccugcgccaaguuccaaugucuggaacccaucgaggggaaagucguucaguacgaaaaucugaaguauacagugauuaucaccguccacacgggagaccagcaucaggugggcaacgagacacaaggggugaccgccgagaucacaccucaggcuagcaccaccgaagccauucuccccgaguacggaacacugggccuugaaugcuccccucgcacgggccuggauuuuaaugagaugauccuccugaccaugaaaaacaaggcuuggaugguccacagacagugguucuuugaccuuccccugccuuggacaucuggggccaccacagaaaccccgacguggaaucggaaagagcuccugguuacauucaagaacgcgcaugccaagaaacaggagguggugguccugggaagccaagaaggcgcuaugcacaccgcccucaccggggcuacagagauucaaaauuccggaggcaccucuaucuuugccgggcaccugaagugucgccuuaaaauggauaagcuggaacucaaaggaaugagcuaugcgaugugcacaaacacguucgugcugaagaaagagguuuccgaaacccagcauggcacaauucuuaucaagguggaguacaagggcgaggacguccccuguaaaauuccuuuuagcaccgaagaugggcagggaaaggcccacaauggcagacugaucacagcuaaccccgugguuaccaaaaaggaggaaccugugaauaucgaggccgaacccccguucggggagucuaacauugucaucggaauuggcgacaacgcucucaaaaucaauugguauaagaag

SEQ ID NO: 2131 - RNA, 1269 nt, Artificial Sequence
  derived and/or modified CDS sequence (opt5) from DENV-3 Consensus__EdelTM-variant (aa1-422)
augagaugcgugggcgucgggaaccgggacuucguugagggacugagcggcgccaccuggguggaugugguccucgaacacgggggaugugugacaacgauggcuaagaauaaacccacccuggacaucgagcuucagaagacagaagccacccaacuggcgacacuccgcaaacugugcauugagggcaagaucaccaacauuacaaccgauuccagauguccuacgcagggggaagcuacccuuccggaggagcaggaccagaauuacguuugcaaacauacauauguggaucggggauggggcaacggcugugggcuguuuggaaagggcucucucgugaccugcgccaaguuccaaugucuggaacccaucgaggggaaagucguucaguacgaaaaucugaaguauacagugauuaucaccguccacacgggagaccagcaucaggugggcaacgagacacaaggggugaccgccgagaucacaccucaggcuagcaccaccgaagccauucuccccgaguacggaacacugggccuugaaugcuccccucgcacgggccuggauuuuaaugagaugauccuccugaccaugaaaaacaaggcuuggaugguccacagacagugguucuuugaccuuccccugccuuggacaucuggggccaccacagaaaccccgacguggaaucggaaagagcuccugguuacauucaagaacgcgcaugccaagaaacaggagguggugguccugggaagccaagaaggcgcuaugcacaccgcccucaccggggcuacagagauucaaaauuccggaggcaccucuaucuuugccgggcaccugaagugucgccuuaaaauggauaagcuggaacucaaaggaaugagcuaugcgaugugcacaaacacguucgugcugaagaaagagguuuccgaaacccagcauggcacaauucuuaucaagguggaguacaagggcgaggacguccccuguaaaauuccuuuuagcaccgaagaugggcagggaaaggcccacaauggcagacugaucacagcuaaccccgugguuaccaaaaaggaggaaccugugaauaucgaggccgaacccccguucggggagucuaacauugucaucggaauuggcgacaacgcucucaaaaucaauugguauaagaagggguccagcauuggcaaaauguuugaggccacggcccggggagcucgcagaauggcgauccugggcgauaccgccugggacuucgggucuuga

SEQ ID NO: 2132 - RNA, 1260 nt, Artificial Sequence
  derived and/or modified CDS sequence (opt5) from DENV-3 Consensus__EdelTM-variant (aa1-419)
augagaugcgugggcgucgggaaccgggacuucguugagggacugagcggcgccaccuggguggaugugguccucgaacacgggggaugugugacaacgauggcuaagaauaaacccacccuggacaucgagcuucagaagacagaagccacccaacuggcgacacuccgcaaacugugcauugagggcaagaucaccaacauuacaaccgauuccagauguccuacgcagggggaagcuacccuuccggaggagcaggaccagaauuacguuugcaaacauacauauguggaucggggauggggcaacggcugugggcuguuuggaaagggcucucucgugaccugcgccaaguuccaaugucuggaacccaucgaggggaaagucguucaguacgaaaaucugaaguauacagugauuaucaccguccacacgggagaccagcaucaggugggcaacgagacacaaggggugaccgccgagaucacaccucaggcuagcaccaccgaagccauucuccccgaguacggaacacugggccuugaaugcuccccucgcacgggccuggauuuuaaugagaugauccuccugaccaugaaaaacaaggcuuggaugguccacagacagugguucuuugaccuuccccugccuuggacaucuggggccaccacagaaaccccgacguggaaucggaaagagcuccugguuacauucaagaacgcgcaugccaagaaacaggagguggugguccugggaagccaagaaggcgcuaugcacaccgcccucaccggggcuacagagauucaaaauuccggaggcaccucuaucuuugccgggcaccugaagugucgccuuaaaauggauaagcuggaacucaaaggaaugagcuaugcgaugugcacaaacacguucgugcugaagaaagagguuuccgaaacccagcauggcacaauucuuaucaagguggaguacaagggcgaggacguccccuguaaaauuccuuuuagcaccgaagaugggcagggaaaggcccacaauggcagacugaucacagcuaaccccgugguuaccaaaaaggaggaaccugugaauaucgaggccgaacccccguucggggagucuaacauugucaucggaauuggcgacaacgcucucaaaaucaauugguauaagaagggguccagcauuggcaaaauguuugaggccacggcccggggagcucgcagaauggcgauccugggcgauaccgccugggacuga

SEQ ID NO: 2133 - RNA, 1155 nt, Artificial Sequence
  derived and/or modified CDS sequence (opt5) from DENV-3 Consensus__Edelaa101-107
augagaugcgugggcgucgggaaccgggacuucguugagggacugagcggcgccaccuggguggaugugguccucgaacacgggggaugugugacaacgauggcuaagaauaaacccacccuggacaucgagcuucagaagacagaagccacccaacuggcgacacuccgcaaacugugcauugagggcaagaucaccaacauuacaaccgauuccagauguccuacgcagggggaagcuacccuuccggaggagcaggaccagaauuacguuugcaaacauacauauguggaucggggauuuggcaagggcucucuggucaccugugccaaguuccaaugccucgaacccaucgaggggaaagugguucaguacgaaaaccugaaguauacagugauuaucaccguccacacgggagaccagcaucaggugggcaaugagacacaaggggugaccgccgagaucacaccucaggcuagcaccaccgaagccauucugcccgaguacggaacacucggccuggaauguuccccucgcacggggcuugauuuuaacgagaugauccugcucaccaugaaaaauaaggcuuggaugguccacagacagugguucuuugaccugccccuuccuuggacaucuggagccaccacagaaaccccgacguggaaccggaaagagcugcucguuacauucaagaaugcgcaugccaagaaacaggagguggugguccugggcagccaagaaggcgcuaugcacaccgcccugaccggggcuacagagauucagaacuccggaggcaccucuaucuuugccgggcaccucaagugccgccugaaaauggauaaacuugaacugaagggaaugagcuaugcgauguguacaaauacguucgugcucaagaaagagguuuccgaaacccagcauggcacaauucugaucaagguggaguacaagggggaggacguccccugcaaaauuccuuuuagcaccgaagauggacaaggcaaggcccacaacggcagacuuaucacagcuaaucccgugguuaccaaaaaggaggaaccugugaacaucgaggccgaacccccguucggggagucuaauauugucaucggaauuggcgacaacgcucugaaaaucaacugguauaagaag

SEQ ID NO: 2134 - RNA, 1173 nt, Artificial Sequence
  derived and/or modified CDS sequence (opt5) from DENV-3 Consensus__EdelTM-variant (aa1-391)
augagaugcgugggcgucgggaaccgggacuucguugagggacugagcggcgccaccuggguggaugugguccucgaacacgggggaugugugacaacgauggcuaagaauaaacccacccuggacaucgagcuucagaagacagaagccacccaacuggcgacacuccgcaaacugugcauugagggcaagaucaccaacauuacaaccgauuccagauguccuacgcagggggaagcuacccuuccggaggagcaggaccagaauuacguuugcaaacauacauauguggaucggggauggggcaacggcugugggcuguuuggaaagggcucucucgugaccugcgccaaguuccaaugucuggaacccaucgaggggaaagucguucaguacgaaaaucugaaguauacagugauuaucaccguccacacgggagaccagcaucaggugggcaacgagacacaaggggugaccgccgagaucacaccucaggcuagcaccaccgaagccauucuccccgaguacggaacacugggccuugaaugcuccccucgcacgggccuggauuuuaaugagaugauccuccugaccaugaaaaacaaggcuuggaugguccacagacagugguucuuugaccuuccccugccuuggacaucuggggccaccacagaaaccccgacguggaaucggaaagagcuccugguuacauucaagaacgcgcaugccaagaaacaggagguggugguccugggaagccaagaaggcgcuaugcacaccgcccucaccggggcuacagagauucaaaauuccggaggcaccucuaucuuugccgggcaccugaagugucgccuuaaaauggauaagcuggaacucaaaggaaugagcuaugcgaugugcacaaacacguucgugcugaagaaagagguuuccgaaacccagcauggcacaauucuuaucaagguggaguacaagggcgaggacguccccuguaaaauuccuuuuagcaccgaagaugggcagggaaaggcccacaauggcagacugaucacagcuaaccccgugguuaccaaaaaggaggaaccugugaauaucgaggccgaacccccguucggggagucuaacauugucaucggaauuggcgacaacgcucucaaaaucaauugguauaag

SEQ ID NO: 2135 - RNA, 2025 nt, Artificial Sequence
  derived and/or modified CDS sequence (opt5) from DENV-3 Consensus__SSc-prME
augaccagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcgccagguggaaaaaguugagacaugggcccuccggcaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaggggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggcccggcgcauggcuauccuuggagacaccgccugggauuucggcuccguugggggagugcucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcuuga

SEQ ID NO: 2136 - RNA, 2025 nt, Artificial Sequence
  derived and/or modified CDS sequence (opt5) from DENV-3 Consensus__SSc-prME(F108S)
augaccagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcgccagguggaaaaaguugagacaugggcccuccggcaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccugagcgggaagggaucucuugucacaugcgccaaguuccaaugucuggagcccauugagggcaaagugguucaguaugaaaaucucaaguacaccgugaucaucacaguccauacgggggaccagcaccaggugggaaacgagacccaaggcguuacagcugaaauuaccccucaggccuccacaaccgaggcuauccugcccgaauauggcacgcuggggcucgagugcagcccucgcaccggacuggacuuuaaugagaugauucuucugacaaugaaaaacaaggccuggauggugcauagacagugguucuuugaucucccccugccguggaccucuggcgccacaaccgaaacgccuacauggaaucggaaagagcuucuggucaccuucaagaacgcucacgcgaaaaagcaagaaguggucgugcucgggucccaggagggagccaugcacacagcucugaccggcgccaccgaaauccagaauagcgggggcacaucuauuuuugccggacaucugaagugucgccucaaaauggacaagcuggagcuuaaaggcauguccuacgcuaugugcacgaacaccuucguucugaagaaagaggugagcgaaacacagcacgggaccauccucaucaaggucgaguacaagggagaagaugugcccuguaaaauuccuuuuuccacagaggacggccaagggaaggcccauaacggaagacugaucaccgcgaaucccguugugacgaaaaaggaggaacccgucaacauugaggcugaaccuccguucggcgagucuaauaucgugauugggaucggcgauaacgcccugaaaaucaauugguauaagaagggaagcuccauuggcaaaauguucgaagccacagcuagaggggcccggcgcauggcuauccuuggagacaccgccugggauuuuggcagcguugggggagugcucaacucucugggcaagaugguccaccagauuuucggguccgcguacaccgcccuguuuagcggcgugucuugggugaugaaaaucggaauuggcguccuccugacauggaucgggcuuaauagcaagaacaccuccaugucuuucagcugcauugcuaucggaaucauuacacuguaucucggcgccgugguucaggcuuga

SEQ ID NO: 2137 - RNA, 2025 nt, Artificial Sequence
  derived and/or modified CDS sequence (opt5) from DENV-3 Consensus__SSc-prME(R186L)
augaccagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcgccagguggaaaaaguugagacaugggcccuccggcaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucugaccggacuugacuucaaugagaugauucugcucacaaugaaaaacaaggccuggauggugcaucgccagugguuuuucgaucugccccuuccguggaccagcggcgccacaaccgaaacgccuacauggaauagaaaagagcugcucgucaccuuuaagaacgcucacgcgaaaaagcaagaaguggucgugcuggggucucaggagggagccaugcacacagcucugaccggcgccaccgaaauccaaaauuccgggggcacaagcauuuucgccggacaucucaagugucggcugaaaauggacaagcuggagcugaaaggcaugucuuacgcuaugugcacgaacaccuuuguucucaagaaagagguguccgaaacacagcacgggaccauccugaucaaggucgaguacaagggagaagaugugcccuguaaaauuccuuucagcacagaggacggccaggggaaggcccauaacggacgccugaucaccgcgaaucccguugugacgaaaaaggaggaacccgucaacauugaggcugaaccuccguucggcgaguccaauaucgugauugggaucggcgauaacgcccuuaaaaucaauugguauaagaagggaucuagcauuggcaaaauguuugaagccacagcuagaggggcccggagaauggcuauccucggagacaccgccugggauuucggcuccguugggggagugcugaacagccugggcaagaugguccaccagauuuuugggucugcguacaccgcccucuucuccggcgugagcugggugaugaaaaucggaauuggcguccugcuuacauggaucgggcuuaauucuaagaacaccagcauguccuuuucuugcauugcuaucggaaucauuacacucuaucugggcgccgugguucaggcuuga

SEQ ID NO: 2138 - RNA, 2025 nt, Artificial Sequence
  derived and/or modified CDS sequence (opt5) from DENV-3 Consensus__SSc-prME(A265T)
augaccagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcgccagguggaaaaaguugagacaugggcccuccggcaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcaccacagaaauccaaaauuccgggggcacgagcauuuucgccggacaucugaagugucgccucaaaauggacaagcuggagcuuaaaggcaugucuuacgccaugugcaccaacacauuuguucugaagaaagagguguccgaaacccagcacgggacaauccucaucaaggucgaguacaagggagaagaugugcccuguaaaauuccuuucagcaccgaggacggccaggggaaggcucauaacggaagacugaucacggccaaucccguugugaccaaaaaggaggaacccgucaacauugaggcggaaccuccguucggcgaguccaauaucgugauugggaucggcgauaacgcucugaaaaucaauugguauaagaagggaucuagcauuggcaaaauguuugaagccacagccagaggggcucggcgcauggccauccuuggagacaccgcuugggauuucggcuccguugggggagugcucaacagccugggcaagaugguccaccagauuuuugggucugccuacacagcgcuguucuccggcgugagcugggugaugaaaaucggaauuggcguccuccugaccuggaucgggcuuaauucuaagaacacaagcauguccuuuucuugcauugccaucggaaucauuacgcuguaucucggcgcugugguucaggccuga

SEQ ID NO: 2139 - RNA, 2025 nt, Artificial Sequence
  derived and/or modified CDS sequence (opt5) from DENV-3 Consensus__SSc-prMEdelstem_TM-JEV
augaccagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcgccagguggaaaaaguugagacaugggcccuccggcaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaggggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuacacuuggcaaagccuuuagcaccacccucaagggggcucagcggcuggccgcucugggagacacagccugggauuucggcuccauugggggaguguuuaacagcaucggcagagcgguucaccaggucuucgggggcgccuuucgcacccucuucggaggcaugucuuggauuacacaggggcugaugggagcccuucugcucuggaugggcgugaaugcucgggacagauccaucgcucuggccuuucuggcgaccgggggagugcuugucuuccucgccacgaacgugcaugcuuga

SEQ ID NO: 2140 - RNA, 1326 nt, Artificial Sequence
  derived and/or modified CDS sequence (opt5) from DENV-3 Consensus__SSm-EdelTM
augacccagaagguggucaucuucauucugcucaugcugguuacacccagcaugacgaugagaugcgugggcguggggaaccgggacuuugucgagggacuuuccggcgccaccuggguggauguugugcuggaacacgggggaugugucacaaccauggcuaaaaauaagccuacacucgacaucgagcugcagaaaaccgaagccacacagcuugcgacccugcgcaagcucugcauugagggcaaaaucacgaacauuaccacagauucuagauguccgacccagggggaagcuacacugcccgaggagcaggaccaaaauuacgugugcaagcauaccuauguugaucggggauggggcaacggcugugggcuguucggaaagggcagccucgugacgugcgccaaauuucagugucuggaaccuaucgaggggaaggucgugcaguacgaaaaucuuaaauauacagugaucauuaccguccacacaggagaccagcaucaaguuggcaacgagacccagggggugaccgccgagaucacaccccaggcuuccacgaccgaagccauucugccugaguacggaacacucggccuggaaugcucuccccgcaccggccuugauuucaaugagaugauccugcucacaaugaagaacaaggcuuggauggugcacagacagugguuuuucgaccugccucugccguggaccagcggggccacgacagaaacccccaccuggaaucggaaagagcuccuggucacauuuaagaacgcgcaugccaaaaagcaagaggugguugugcuuggaucccaggaaggcgcuaugcacaccgcccugacaggggcuacggagauucaaaauucuggaggcaccagcaucuucgccgggcaccucaaaugucgccugaagauggauaaacuugaacugaagggaauguccuaugcgaugugcacaaacaccuuuguccucaaaaaggaggugagcgaaacacaacauggcaccauucugaucaagguugaguacaaaggcgaggacgugccuuguaagauccccuucucuacggaagaugggcagggaaaagcccacaauggcagacugauuaccgcuaacccugucgugacaaagaaagaggaacccgucaauaucgaggccgaaccgccuuuuggggaguccaacauugugaucggaauuggcgacaacgcucucaagaucaauugguauaagaaagggagcucuaucggcaagauguucgaggccaccgcccggggagcucgcagaauggcgauucugggcgauacagccugggacuuuggguccuga

SEQ ID NO: 2141 - RNA, 2373 nt, Artificial Sequence
  derived and/or modified CDS sequence (opt5) from DENV-3 Consensus__C-P2A-SSc-prME
augaacaaucagagaaagaaaaccggcaagcccagcaucaacaugcugaaacgggugcgcaauagagucuccacagggucucaacucgccaagcgguucagcaaaggacugcuuaacggccaggggccuaugaagcugguuauggcuuuuauugccuuccuccgcuuucuggcgaucccgcccacggcuggagugcuugccagauggggcaccuucaagaaauccggggccauuaaggugcugaaaggauuuaagaaagagaucucuaauaugcucagcauuaucaacaagcggaagaaaaauuucgaccugcugaagcucgcuggcgaugucgaauccaacccuggccccacaucucugugccuuaugaugauccugccugccgcucucgccuuucaccugaccagccgcgacggggagcccagaaugauugugggcaaaaaugaacggggaaagucccuucuguucaaaacagcgagcgggaucaacauguguacccucauugccauggaucugggagagaugugcgacgauacaguuaccuacaaguguccucauaucacggaaguggagccggaggacauugauugcugguguaaucugaccucuacaugggucaccuauggcacaugcaaccaggcuggggaacaccgcagagacaaacgguccguggcccucgcuccccauguuggaaugggccuggauacccgcacgcagacauggaugagcgccgagggcgcguggagacaaguggaaaaggucgagaccugggcccuucggcacccuggguuuacaauccuggcucucuuccuggcccauuacauuggaaccucucuuacccagaagguggugaucuuuauccugcucaugcuggucacacccuccaugacgaugcgcuguguuggcguggggaauagagacuucguggagggacugagcggcgcuaccugggucgaugugguucucgaacacgggggaugcgugacaaccauggccaaaaacaagccuacacuggacauugagcuucagaaaaccgaagccacgcagcuggcuacacuccggaagcuguguaucgagggcaaaauuaccaauaucaccacagauucuagaugccccacccaaggcgaagcgacacuuccggaggagcaggaccagaacuaugucuguaagcacacguacguggaccgcggguggggaaacggcugcgggcuguuuggaaagggcucccucguuaccugcgccaaauuccagugucuggaaccuauugaggggaaggugguccaauaugaaaaucugaaauacacagugaucaucaccguccauacaggcgaucagcaccaggugggaaacgagacccaaggcguuacggcugaaauuacaccccaggccagcaccaccgaggccauccucccugaguaugggacacugggacuugaaugcucuccccggaccggccuggacuucaaugagaugauucuccugacgaugaagaacaaggcuuggauggugcauagacagugguuuuucgaucugccccuuccuuggacauccggggccaccacagaaaccccgaccuggaaucgcaaagagcuccuggucacauuuaagaacgcgcacgcuaaaaagcaggaagugguugugcugggaagccaagagggcgccaugcacacggcccucaccggggcuacagagauccaaaauuccggcggaaccagcauuuucgccggccaucugaaaugucggcuuaagauggacaaacuggaacucaaggggaugucuuacgcuaugugcacaaacaccuuuguccugaagaaagagguguccgaaacgcagcacggaacaauccugaucaagguggaguacaaaggcgaggauguucccuguaagauuccuuucagcaccgaagacgggcagggaaaagcccauaauggcagacuuaucaccgcgaaccccgucgugacaaagaaagaggaaccugugaauauugaggccgaacccccguuuggggagucuaacaucgucauuggcaucggagauaaugcucucaagauuaacugguauaagaaaggcagcuccaucgggaagauguucgaggccaccgcucgcggagcccggagaauggcgauccugggcgacacagccugggauuuugggucugugggaggcguucugaauagccucgggaaaauggugcaccagauuuucggcuccgcuuacacggcccuguuuagcggagucucuugggugaugaagaucggcauugggguucuucugaccuggaucggacucaacuccaaaaacacaagcaugucuuucuccugcauugcuaucggcaucauuacccuguaucugggggccgugguccaggccuga

SEQ ID NO: 2142 - RNA, 2037 nt, Artificial Sequence
  derived and/or modified CDS sequence (opt5) from DENV-3 Consensus__SSopt-prME
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccuagaaccggacuggacuucaaugagaugauucuucugacaaugaagaacaaagccuggauggugcaucggcagugguuuuucgaucucccccugccguggaccagcggcgccacaaccgaaacgccuacauggaaucgcaaggagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaaauguagacucaagauggacaaacuggagcuuaagggcaugucuuacgcuaugugcacgaacaccuuuguucugaagaaagagguguccgaaacacagcacgggaccauccucaucaaggucgaguacaaaggagaagaugugcccuguaagauuccuuucagcacagaggacggccaggggaaagcccauaacggacggcugaucaccgcgaaucccguugugacgaagaaggaggaacccgucaacauugaggcugaaccuccguucggcgaguccaauaucgugauugggaucggcgauaacgcccugaaaaucaauugguauaagaaaggaucuagcauuggcaagauguuugaagccacagcuagaggggcccgccggauggcuauccuuggagacaccgccugggauuucggcuccguugggggagugcucaacagccugggcaaaaugguccaccagauuuuugggucugcguacaccgcccuguucuccggcgugagcugggugaugaagaucggaauuggcguccuccugacauggaucgggcuuaauucuaagaacaccagcauguccuuuucuugcauugcuaucggaaucauuacacuguaucucggcgccgugguucaggcuuga

SEQ ID NO: 2143 - RNA, 2037 nt, Artificial Sequence
  derived and/or modified CDS sequence (opt5) from DENV-3 Consensus__SSopt-prME(F108S)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccugagcgggaagggaucucuugucacaugcgccaaauuccaaugucuggagcccauugagggcaaggugguucaguaugaaaaucucaaauacaccgugaucaucacaguccauacgggggaccagcaccaggugggaaacgagacccaaggcguuacagcugaaauuaccccucaggccuccacaaccgaggcuauccugcccgaauauggcacgcuggggcucgagugcagcccuagaaccggacuggacuuuaaugagaugauucuucugacaaugaagaacaaagccuggauggugcaucggcagugguucuuugaucucccccugccguggaccucuggcgccacaaccgaaacgccuacauggaaucgcaaggagcuucuggucaccuucaagaacgcucacgcgaaaaagcaagaaguggucgugcucgggucccaggagggagccaugcacacagcucugaccggcgccaccgaaauccagaauagcgggggcacaucuauuuuugccggacaucugaaauguagacucaagauggacaaacuggagcuuaagggcauguccuacgcuaugugcacgaacaccuucguucugaagaaagaggugagcgaaacacagcacgggaccauccucaucaaggucgaguacaaaggagaagaugugcccuguaagauuccuuuuuccacagaggacggccaagggaaagcccauaacggacggcugaucaccgcgaaucccguugugacgaagaaggaggaacccgucaacauugaggcugaaccuccguucggcgagucuaauaucgugauugggaucggcgauaacgcccugaaaaucaauugguauaagaaaggaagcuccauuggcaagauguucgaagccacagcuagaggggcccgccggauggcuauccuuggagacaccgccugggauuuuggcagcguugggggagugcucaacucucugggcaaaaugguccaccagauuuucggguccgcguacaccgcccuguuuagcggcgugucuugggugaugaagaucggaauuggcguccuccugacauggaucgggcuuaauagcaagaacaccuccaugucuuucagcugcauugcuaucggaaucauuacacuguaucucggcgccgugguucaggcuuga

SEQ ID NO: 2144 - RNA, 2037 nt, Artificial Sequence
  derived and/or modified CDS sequence (opt5) from DENV-3 Consensus__SSopt-prME(H27N)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagaauggcgggugcguuaccacaauggccaaaaacaagcccacgcuggacauugagcuccagaaaaccgaagcuacacaacuggccacccuuagaaagcuguguaucgagggaaagauuacaaauaucaccacggauucccggugcccuacacagggcgaagcgacccucccggaggaacaggaccagaacuauguguguaaacacaccuacguggaucgcggcugggggaauggaugcggccuguucgggaagggaagccuugucacaugcgccaaauuucaaugucuggagcccauugagggcaaggugguucaguaugaaaaccucaaauacaccgugaucaucacaguccacacgggggaccagcaucaggugggaaaugagacccaaggcguuacagcugaaauuaccccucaggccucuacaaccgaggcuauccugcccgaauauggcacgcuggggcucgagugcuccccuagaaccggacuggacuucaacgagaugauucuucugacaaugaagaauaaagccuggauggugcaccggcagugguuuuucgaucucccccugccguggaccagcggcgccacaaccgaaacgccuacauggaaccgcaaggagcuucuggucaccuuuaagaaugcucaugcgaaaaagcaagaaguggucgugcucgggucucaggagggagccaugcacacagcucugaccggcgccaccgaaauccagaacuccgggggcacaagcauuuucgccggacaccugaaauguagacucaagauggacaaacuggagcuuaagggcaugucuuacgcuaugugcacgaacaccuuuguucugaagaaagagguguccgaaacacagcaugggaccauccucaucaaggucgaguacaaaggagaagaugugcccuguaagauuccuuucagcacagaggacggccaagggaaagcccacaauggacggcugaucaccgcgaaccccguugugacgaagaaggaggaacccgucaauauugaggcugaaccuccguucggcgaguccaacaucgugauugggaucggcgauaaugcccugaaaaucaacugguauaagaaaggaucuagcauuggcaagauguuugaagccacagcuagaggggcccgccggauggcuauccuuggagacaccgccugggauuucggcuccguugggggagugcucaauagccugggcaaaaugguccaucagauuuuugggucugcguacaccgcccuguucuccggcgugagcugggugaugaagaucggaauuggcguccuccugacauggaucgggcuuaacucuaagaauaccagcauguccuuuucuugcauugcuaucggaaucauuacacuguaucucggcgccgugguucaggcuuga

SEQ ID NO: 2145 - RNA, 2037 nt, Artificial Sequence
  derived and/or modified CDS sequence (opt5) from DENV-3 Consensus__SSopt-prME(T76I)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuauucagggcgaagcgacacucccggaggaacaggaccagaauuauguguguaaacacaccuacguggaucgcggcugggggaacggaugcggccuguucgggaagggaagccuugugaccugcgccaaauuucaaugucuggagcccaucgagggcaaggugguucaguaugaaaaucucaaauacacagugaucauuaccguccauacaggggaccagcaccaggugggaaacgagacgcaaggcguuaccgcugaaaucacaccucaggccucuaccacagaggcuauucugcccgaauauggcacccuggggcucgagugcuccccuagaacgggacuggacuucaaugagaugauccuucugaccaugaagaacaaagccuggauggugcaucggcagugguuuuucgaucucccccugccguggacaagcggcgccaccacagaaaccccuacguggaaucgcaaggagcuucuggucacauuuaagaacgcucacgcgaaaaagcaagaaguggucgugcucgggucucaggagggagccaugcacaccgcucugacaggcgccaccgaaauucaaaauuccgggggcaccagcaucuucgccggacaucugaaauguagacucaagauggacaaacuggagcuuaagggcaugucuuacgcuaugugcacaaacacguuuguucugaagaaagagguguccgaaacccagcacgggacaauccucauuaaggucgaguacaaaggagaagaugugcccuguaagaucccuuucagcaccgaggacggccaggggaaagcccauaacggacggcugauuacagcgaaucccguugugaccaagaaggaggaacccgucaacaucgaggcugaaccuccguucggcgaguccaauauugugaucgggaucggcgauaacgcccugaaaauuaauugguauaagaaaggaucuagcaucggcaagauguuugaagccacggcuagaggggcccgccggauggcuauucuuggagacacagccugggauuucggcuccgucgggggaguucucaacagccugggcaaaaugguccaccagaucuuugggucugcguacaccgcccuguucuccggcgugagcugggugaugaagauuggaaucggcguccuccugaccuggauugggcuuaauucuaagaacacaagcauguccuuuucuugcaucgcuaucggaauuaucacccuguaucucggcgccgugguucaggcuuga

SEQ ID NO: 2146 - RNA, 2037 nt, Artificial Sequence
  derived and/or modified CDS sequence (opt5) from DENV-3 Consensus__SSopt-prME(N89D)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccaggauuauguguguaaacacaccuacguggaccgcggcugggggaauggaugcggccuguucgggaagggaagccuugucacaugcgccaaauuucaaugucuggagcccauugagggcaaggugguucaguaugaaaaccucaaauacaccgugaucaucacaguccauacgggggaccagcaccaggugggaaaugagacccaaggcguuacagcugaaauuaccccucaggccucuacaaccgaggcuauccugcccgaauauggcacgcuggggcucgagugcuccccuagaaccggacuggauuucaacgagaugauucuucugacaaugaagaauaaagccuggauggugcaucggcagugguuuuucgaccucccccugccguggaccagcggcgccacaaccgaaacgccuacauggaaccgcaaggagcuucuggucaccuuuaagaaugcucacgcgaaaaagcaagaaguggucgugcucgggucucaggagggagccaugcacacagcucugaccggcgccaccgaaauccagaacuccgggggcacaagcauuuucgccggacaucugaaauguagacucaagauggauaaacuggagcuuaagggcaugucuuacgcuaugugcacgaauaccuuuguucugaagaaagagguguccgaaacacagcacgggaccauccucaucaaggucgaguacaaaggagaagacgugcccuguaagauuccuuucagcacagaggauggccaagggaaagcccauaacggacggcugaucaccgcgaaccccguugugacgaagaaggaggaacccgucaauauugaggcugaaccuccguucggcgaguccaacaucgugauugggaucggcgacaaugcccugaaaaucaacugguauaagaaaggaucuagcauuggcaagauguuugaagccacagcuagaggggcccgccggauggcuauccuuggagauaccgccugggacuucggcuccguugggggagugcucaauagccugggcaaaaugguccaccagauuuuugggucugcguacaccgcccuguucuccggcgugagcugggugaugaagaucggaauuggcguccuccugacauggaucgggcuuaacucuaagaauaccagcauguccuuuucuugcauugcuaucggaaucauuacacuguaucucggcgccgugguucaggcuuga

SEQ ID NO: 2147 - RNA, 2037 nt, Artificial Sequence
  derived and/or modified CDS sequence (opt5) from DENV-3 Consensus__SSopt-prME(Y96H)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacacccauguggaucgcggcugggggaacggaugcggccuguucgggaagggaagccuugucacaugcgccaaauuucaaugucuggagcccauugagggcaaggugguucaguacgaaaaucucaaauauaccgugaucaucacaguccacacgggggaccagcaucaggugggaaacgagacccaaggcguuacagcugaaauuaccccucaggccucuacaaccgaggcuauccugcccgaauacggcacgcuggggcucgagugcuccccuagaaccggacuggacuucaaugagaugauucuucugacaaugaagaacaaagccuggauggugcaccggcagugguuuuucgaucucccccugccguggaccagcggcgccacaaccgaaacgccuacauggaaucgcaaggagcuucuggucaccuuuaagaacgcucacgcgaaaaagcaagaaguggucgugcucgggucucaggagggagccaugcauacagcucugaccggcgccaccgaaauccaaaauuccgggggcacaagcauuuucgccggacaccugaaauguagacucaagauggacaaacuggagcuuaagggcaugucuuaugcuaugugcacgaacaccuuuguucugaagaaagagguguccgaaacacagcaugggaccauccucaucaaggucgaguacaaaggagaagaugugcccuguaagauuccuuucagcacagaggacggccaggggaaagcccacaacggacggcugaucaccgcgaaucccguugugacgaagaaggaggaacccgucaacauugaggcugaaccuccguucggcgaguccaauaucgugauugggaucggcgauaacgcccugaaaaucaauugguacaagaaaggaucuagcauuggcaagauguuugaagccacagcuagaggggcccgccggauggcuauccuuggagacaccgccugggauuucggcuccguugggggagugcucaacagccugggcaaaaugguccaucagauuuuugggucugcguauaccgcccuguucuccggcgugagcugggugaugaagaucggaauuggcguccuccugacauggaucgggcuuaauucuaagaacaccagcauguccuuuucuugcauugcuaucggaaucauuacacuguaccucggcgccgugguucaggcuuga

SEQ ID NO: 2148 - RNA, 2037 nt, Artificial Sequence
  derived and/or modified CDS sequence (opt5) from DENV-3 Consensus__SSopt-prME(K110E)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucggggagggaagccuugucacaugcgccaaguuucaaugucuggagcccauugaaggcaaagugguucaguaugagaaucucaaguacaccgugaucaucacaguccauacgggggaccagcaccaggugggaaacgaaacccaaggcguuacagcugagauuaccccucaggccucuacaaccgaagcuauccugcccgaguauggcacgcuggggcucgagugcuccccuagaaccggacuggacuucaaugaaaugauucuucugacaaugaaaaacaaggccuggauggugcaucggcagugguuuuucgaucucccccugccguggaccagcggcgccacaaccgagacgccuacauggaaucgcaaagaacuucuggucaccuuuaagaacgcucacgcgaagaaacaagagguggucgugcucgggucucaggaaggagccaugcacacagcucugaccggcgccaccgagauccaaaauuccgggggcacaagcauuuucgccggacaucugaaguguagacucaaaauggacaagcuggagcuuaaaggcaugucuuacgcuaugugcacgaacaccuuuguucugaagaaggaaguguccgagacacagcacgggaccauccucaucaaagucgaauacaagggagaggaugugcccuguaaaauuccuuucagcacagaggacggccaggggaaggcccauaacggacggcugaucaccgcgaaucccguugugacgaaaaaggaggaacccgucaacauugaagcugagccuccguucggcgaauccaauaucgugauugggaucggcgauaacgcccugaagaucaauugguauaaaaagggaucuagcauuggcaaaauguuugaggccacagcuagaggggcccgccggauggcuauccuuggagacaccgccugggauuucggcuccguugggggagugcucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcuuga

SEQ ID NO: 2149 - RNA, 2037 nt, Artificial Sequence
  derived and/or modified CDS sequence (opt5) from DENV-3 Consensus__SSopt-prME(H149N)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagaaccaggugggaaaugagacccaaggcguuacagcugaaauuaccccucaggccucuacaaccgaggcuauccugcccgaauauggcacgcuggggcucgagugcuccccuagaaccggacuggacuucaacgagaugauucuucugacaaugaagaauaaagccuggauggugcaccggcagugguuuuucgaucucccccugccguggaccagcggcgccacaaccgaaacgccuacauggaaccgcaaggagcuucuggucaccuuuaagaaugcucaugcgaaaaagcaagaaguggucgugcucgggucucaggagggagccaugcacacagcucugaccggcgccaccgaaauccagaacuccgggggcacaagcauuuucgccggacaccugaaauguagacucaagauggacaaacuggagcuuaagggcaugucuuacgcuaugugcacgaacaccuuuguucugaagaaagagguguccgaaacacagcaugggaccauccucaucaaggucgaguacaaaggagaagaugugcccuguaagauuccuuucagcacagaggacggccaagggaaagcccacaauggacggcugaucaccgcgaaccccguugugacgaagaaggaggaacccgucaauauugaggcugaaccuccguucggcgaguccaacaucgugauugggaucggcgauaaugcccugaaaaucaacugguauaagaaaggaucuagcauuggcaagauguuugaagccacagcuagaggggcccgccggauggcuauccuuggagacaccgccugggauuucggcuccguugggggagugcucaauagccugggcaaaaugguccaucagauuuuugggucugcguacaccgcccuguucuccggcgugagcugggugaugaagaucggaauuggcguccuccugacauggaucgggcuuaacucuaagaauaccagcauguccuuuucuugcauugcuaucggaaucauuacacuguaucucggcgccgugguucaggcuuga

SEQ ID NO: 2150 - RNA, 2037 nt, Artificial Sequence
  derived and/or modified CDS sequence (opt5) from DENV-3 Consensus__SSopt-prME(S184F)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuucccuagaaccggacuggacuuuaaugagaugauucuucugacaaugaagaacaaagccuggauggugcaucggcagugguucuuugaucucccccugccguggaccuccggcgccacaaccgaaacgccuacauggaaucgcaaggagcuucuggucaccuucaagaacgcucacgcgaaaaagcaagaaguggucgugcucgggagccaggagggagccaugcacacagcucugaccggcgccaccgaaauccaaaauucugggggcacauccauuuuugccggacaucugaaauguagacucaagauggacaaacuggagcuuaagggcaugagcuacgcuaugugcacgaacaccuucguucugaagaaagaggugucugaaacacagcacgggaccauccucaucaaggucgaguacaaaggagaagaugugcccuguaagauuccuuucuccacagaggacggccaggggaaagcccauaacggacggcugaucaccgcgaaucccguugugacgaagaaggaggaacccgucaacauugaggcugaaccuccguuuggcgagagcaauaucgugauugggaucggcgauaacgcccugaaaaucaauugguauaagaaaggauccucuauuggcaagauguucgaagccacagcuagaggggcccgccggauggcuauccuuggagacaccgccugggauuuuggcagcguugggggagugcucaacucccugggcaaaaugguccaccagauuuucgggagcgcguacaccgcccuguuuucuggcguguccugggugaugaagaucggaauuggcguccuccugacauggaucgggcuuaauagcaagaacaccucuaugagcuucuccugcauugcuaucggaaucauuacacuguaucucggcgccgugguucaggcuuga

SEQ ID NO: 2151 - RNA, 2037 nt, Artificial Sequence
  derived and/or modified CDS sequence (opt5) from DENV-3 Consensus__SSopt-prME(R186L)
augaagcggaaaaagaccagccugugccucaugaugauccugcccgccgcucuugccuuccaccugacaucccgggacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucugaccggacuugacuucaaugagaugauucugcucacaaugaagaacaaagccuggauggugcauagacagugguuuuucgaucugccccuuccguggaccagcggcgccacaaccgaaacgccuacauggaaucggaaggagcugcucgucaccuuuaagaacgcucacgcgaaaaagcaagaaguggucgugcuggggucucaggagggagccaugcacacagcucugaccggcgccaccgaaauccaaaauuccgggggcacaagcauuuucgccggacaucucaaaugucgccugaagauggacaaacuugagcugaagggcaugucuuacgcuaugugcacgaacaccuuuguucucaagaaagagguguccgaaacacagcacgggaccauccugaucaaggucgaguacaaaggagaagaugugcccuguaagauuccuuucagcacagaggacggccaggggaaagcccauaacggaagacugaucaccgcgaaucccguugugacgaagaaggaggaacccgucaacauugaggcugaaccuccguucggcgaguccaauaucgugauugggaucggcgauaacgcccuuaaaaucaauugguauaagaaaggaucuagcauuggcaagauguuugaagccacagcuagaggggccagacgcauggcuauccucggagacaccgccugggauuucggcuccguugggggagugcugaacagccugggcaaaaugguccaccagauuuuugggucugcguacaccgcccucuucuccggcgugagcugggugaugaagaucggaauuggcguccugcuuacauggaucgggcucaauucuaagaacaccagcauguccuuuucuugcauugcuaucggaaucauuacacuguaucugggcgccgugguucaggcuuga

SEQ ID NO: 2152 - RNA, 2037 nt, Artificial Sequence
  derived and/or modified CDS sequence (opt5) from DENV-3 Consensus__SSopt-prME(N240S)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccuagaaccggacuggacuucaaugagaugauucuucugacaaugaagaacaaagccuggauggugcaucggcagugguuuuucgaucucccccugccguggaccagcggcgccacaaccgaaacgccuacauggaaucgcaaggagcuucuggucaccuuuaagucugcucacgcgaaaaagcaagaaguggucgugcucgggucccaggagggagccaugcacacagcucugaccggcgccaccgaaauccagaacagcgggggcacaucuauuuucgccggacaucugaaauguagacucaagauggacaaacuggagcuuaagggcauguccuacgcuaugugcacgaauaccuuuguucugaagaaagaggugagcgaaacacagcacgggaccauccucaucaaggucgaguacaaaggagaagaugugcccuguaagauuccuuucuccacagaggacggccaagggaaagcccauaacggacggcugaucaccgcgaaccccguugugacgaagaaggaggaacccgucaauauugaggcugaaccuccguucggcgagucuaacaucgugauugggaucggcgauaaugcccugaaaaucaacugguauaagaaaggaagcuccauuggcaagauguuugaagccacagcuagaggggcccgccggauggcuauccuuggagacaccgccugggauuucggcagcguugggggagugcucaauucucugggcaaaaugguccaccagauuuuuggguccgcguacaccgcccuguucagcggcgugucuugggugaugaagaucggaauuggcguccuccugacauggaucgggcuuaacagcaagaauaccuccaugucuuuuagcugcauugcuaucggaaucauuacacuguaucucggcgccgugguucaggcuuga

SEQ ID NO: 2153 - RNA, 2037 nt, Artificial Sequence
  derived and/or modified CDS sequence (opt5) from DENV-3 Consensus__SSopt-prME(M258L)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccuagaaccggacuggacuucaaugagaugauucuucugacaaugaagaacaaagccuggauggugcaucggcagugguuuuucgaucucccccugccguggaccagcggcgccacaaccgaaacgccuacauggaaucgcaaggagcuucuggucaccuuuaagaacgcucacgcgaaaaagcaagaaguggucgugcucgggucucaggagggagcccugcacacagcucugaccggcgccaccgaaauccaaaauuccgggggcacaagcauuuucgccggacaucucaaauguagacugaagauggacaaacuugagcugaagggcaugucuuacgcuaugugcacgaacaccuuuguucucaagaaagagguguccgaaacacagcacgggaccauccugaucaaggucgaguacaaaggagaagaugugcccuguaagauuccuuucagcacagaggacggccaggggaaagcccauaacggacggcugaucaccgcgaaucccguugugacgaagaaggaggaacccgucaacauugaggcugaaccuccguucggcgaguccaauaucgugauugggaucggcgauaacgcccuuaaaaucaauugguauaagaaaggaucuagcauuggcaagauguuugaagccacagcuagaggggcccgccggauggcuauccucggagacaccgccugggauuucggcuccguugggggagugcugaacagccugggcaaaaugguccaccagauuuuugggucugcguacaccgcccucuucuccggcgugagcugggugaugaagaucggaauuggcguccugcuuacauggaucgggcucaauucuaagaacaccagcauguccuuuucuugcauugcuaucggaaucauuacacuguaucugggcgccgugguucaggcuuga

SEQ ID NO: 2154 - RNA, 2037 nt, Artificial Sequence
  derived and/or modified CDS sequence (opt5) from DENV-3 Consensus__SSopt-prME(H259N)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccuagaaccggacuggacuucaaugagaugauucuucugacaaugaagaacaaagccuggauggugcaucggcagugguuuuucgaucucccccugccguggaccagcggcgccacaaccgaaacgccuacauggaaucgcaaggagcuucuggucaccuuuaagaacgcucacgcgaaaaagcaagaaguggucgugcucgggucucaggagggagccaugaauacagcucugaccggcgccaccgaaauccagaacuccgggggcacaagcauuuucgccggacaccugaaauguagacucaagauggacaaacuggagcuuaagggcaugucuuacgcuaugugcacgaacaccuuuguucugaagaaagagguguccgaaacacagcaugggaccauccucaucaaggucgaguacaaaggagaagaugugcccuguaagauuccuuucagcacagaggacggccaagggaaagcccacaauggacggcugaucaccgcgaaccccguugugacgaagaaggaggaacccgucaauauugaggcugaaccuccguucggcgaguccaacaucgugauugggaucggcgauaaugcccugaaaaucaacugguauaagaaaggaucuagcauuggcaagauguuugaagccacagcuagaggggcccgccggauggcuauccuuggagacaccgccugggauuucggcuccguugggggagugcucaauagccugggcaaaaugguccaucagauuuuugggucugcguacaccgcccuguucuccggcgugagcugggugaugaagaucggaauuggcguccuccugacauggaucgggcuuaacucuaagaauaccagcauguccuuuucuugcauugcuaucggaaucauuacacuguaucucggcgccgugguucaggcuuga

SEQ ID NO: 2155 - RNA, 2037 nt, Artificial Sequence
  derived and/or modified CDS sequence (opt5) from DENV-3 Consensus__SSopt-prME(H259R)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccuagaaccggacuggacuucaaugagaugauucuucugacaaugaagaacaaagccuggauggugcaucggcagugguuuuucgaucucccccugccguggaccagcggcgccacaaccgaaacgccuacauggaaucgcaaggagcuucuggucaccuuuaagaacgcucacgcgaaaaagcaagaaguggucgugcucgggucucaggagggagccaugagaacagcucugaccggcgccaccgaaauccaaaauuccgggggcacaagcauuuucgccggacaccugaaaugucggcucaagauggacaaacuggagcuuaagggcaugucuuacgcuaugugcacgaacaccuuuguucugaagaaagagguguccgaaacacagcaugggaccauccucaucaaggucgaguacaaaggagaagaugugcccuguaagauuccuuucagcacagaggacggccaggggaaagcccacaacggaagacugaucaccgcgaaucccguugugacgaagaaggaggaacccgucaacauugaggcugaaccuccguucggcgaguccaauaucgugauugggaucggcgauaacgcccugaaaaucaauugguauaagaaaggaucuagcauuggcaagauguuugaagccacagcucgcggggcccggagaauggcuauccuuggagacaccgccugggauuucggcuccguugggggagugcucaacagccugggcaaaaugguccaucagauuuuugggucugcguacaccgcccuguucuccggcgugagcugggugaugaagaucggaauuggcguccuccugacauggaucgggcuuaauucuaagaacaccagcauguccuuuucuugcauugcuaucggaaucauuacacuguaucucggcgccgugguucaggcuuga

SEQ ID NO: 2156 - RNA, 2037 nt, Artificial Sequence
  derived and/or modified CDS sequence (opt5) from DENV-3 Consensus__SSopt-prME(A265T)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccuagaaccggacuggacuucaaugagaugauucuucugacaaugaagaacaaagccuggauggugcaucggcagugguuuuucgaucucccccugccguggaccagcggcgccacaaccgaaacgccuacauggaaucgcaaggagcuucuggucaccuuuaagaacgcucacgcgaaaaagcaagaaguggucgugcucgggucucaggagggagccaugcacacagcucugaccggcaccacagaaauccaaaauuccgggggcacgagcauuuucgccggacaucugaaauguagacucaagauggacaaacuggagcuuaagggcaugucuuacgccaugugcaccaacacauuuguucugaagaaagagguguccgaaacccagcacgggacaauccucaucaaggucgaguacaaaggagaagaugugcccuguaagauuccuuucagcaccgaggacggccaggggaaagcucauaacggacggcugaucacggccaaucccguugugacaaagaaggaggaacccgucaacauugaggcggaaccuccguucggcgaguccaauaucgugauugggaucggcgauaacgcucugaaaaucaauugguauaagaaaggaucuagcauuggcaagauguuugaagccaccgccagaggggcucgccggauggccauccuuggagacaccgcuugggauuucggcuccguugggggagugcucaacagccugggcaaaaugguccaccagauuuuugggucugccuacacagcgcuguucuccggcgugagcugggugaugaagaucggaauuggcguccuccugaccuggaucgggcuuaauucuaagaacacaagcauguccuuuucuugcauugccaucggaaucauuacgcuguaucucggcgcugugguucaggccuga

SEQ ID NO: 2157 - RNA, 2037 nt, Artificial Sequence
  derived and/or modified CDS sequence (opt5) from DENV-3 Consensus__SSopt-prME(S296G)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccuagaaccggacuggacuucaaugagaugauucuucugacaaugaagaacaaagccuggauggugcaucggcagugguuuuucgaucucccccugccguggaccagcggcgccacaaccgaaacgccuacauggaaucgcaaggagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaaauguagacucaagauggacaaacuggagcuuaagggcaugggguacgcuaugugcacgaacaccuuuguucugaagaaagaggugucugaaacacagcacggaaccauccucaucaaggucgaguacaaaggcgaagaugugcccuguaagauuccuuucuccacagaggacgggcagggaaaagcccauaacggccggcugaucaccgcgaaucccguugugacgaagaaggaggaacccgucaacauugaggcugaaccuccguucggggagagcaauaucgugauuggcaucggagauaacgcccugaaaaucaauugguauaagaaaggcuccucuauugggaagauguuugaagccacagcuagaggagcccgccggauggcuauccuuggcgacaccgccugggauuucgggagcgugggaggcguucucaacucccuggggaaaaugguccaccagauuuuuggcagcgcguacaccgcccuguucucuggaguguccugggugaugaagaucggcauugggguccuccugacauggaucggacuuaauagcaagaacaccucuaugagcuuuuccugcauugcuaucggcaucauuacacuguaucucggggccgugguucaggcuuga

SEQ ID NO: 2158 - RNA, 2037 nt, Artificial Sequence
  derived and/or modified CDS sequence (opt5) from DENV-3 Consensus__SSopt-prME(S311R)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccuagaaccggacuggacuucaaugagaugauucuucugacaaugaagaacaaagccuggauggugcaucggcagugguuuuucgaucucccccugccguggaccagcggcgccacaaccgaaacgccuacauggaaucgcaaggagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaaauguagacucaagauggacaaacuggagcuuaagggcaugucuuacgcuaugugcacgaacaccuuuguucugaagaaagaggugcgggaaacacagcacgggaccauccucaucaaggucgaguacaaaggagaagaugugcccuguaagauuccuuucuccacagaggacggccaggggaaagcccauaacggaagacugaucaccgcgaaucccguugugacgaagaaggaggaacccgucaacauugaggcugaaccuccguucggcgagagcaauaucgugauugggaucggcgauaacgcccugaaaaucaauugguauaagaaaggauccucuauuggcaagauguuugaagccacagcucgcggggcccggagaauggcuauccuuggagacaccgccugggauuucggcagcguugggggagugcucaacucccugggcaaaaugguccaccagauuuuugggagcgcguacaccgcccuguucucuggcguguccugggugaugaagaucggaauuggcguccuccugacauggaucgggcuuaauagcaagaacaccucuaugagcuuuuccugcauugcuaucggaaucauuacacuguaucucggcgccgugguucaggcuuga

SEQ ID NO: 2159 - RNA, 2037 nt, Artificial Sequence
  derived and/or modified CDS sequence (opt5) from DENV-3 Consensus__SSopt-prME(K321T)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccuagaaccggacuggacuucaaugagaugauucuucugacaaugaagaacaaagccuggauggugcaucggcagugguuuuucgaucucccccugccguggaccagcggcgccacaaccgaaacgccuacauggaaucgcaaggagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaaauguagacucaagauggacaaacuggagcuuaagggcaugucuuacgcuaugugcacgaacaccuuuguucugaagaaagagguguccgaaacacagcacgggaccauccucaucacagucgaguacaagggagaagaugugcccuguaaaauuccuuucagcaccgaggacggccaggggaaggcccauaacggacggcugaucacggcgaaucccguugugaccaaaaaggaggaacccgucaacauugaggcugaaccuccguucggcgaguccaauaucgugauugggaucggcgauaacgcccugaagaucaauugguauaaaaagggaucuagcauuggcaaaauguuugaagccacagcuagaggggcccgccggauggcuauccuuggagacaccgccugggauuucggcuccguugggggagugcucaacagccugggcaagaugguccaccagauuuuugggucugcguacacagcccuguucuccggcgugagcugggugaugaaaaucggaauuggcguccuccugaccuggaucgggcuuaauucuaagaacacaagcauguccuuuucuugcauugcuaucggaaucauuacgcuguaucucggcgccgugguucaggcuuga

SEQ ID NO: 2160 - RNA, 2037 nt, Artificial Sequence
  derived and/or modified CDS sequence (opt5) from DENV-3 Consensus__SSopt-prME(G28C,H242C)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacugcggcuguguuaccacaauggccaaaaauaagcccacgcuggacauugagcuccagaaaaccgaagcuacacaacuggccacccuuagaaagcugugcaucgaggggaagauuacaaacaucaccacggauucccgguguccuacacagggagaagcgacccucccggaggaacaggaccagaauuaugugugcaaacacaccuacguggaucgcggcuggggcaacgggugcggacuguucggcaaggggagccuugucacaugugccaaauuucaaugccuggagcccauugagggaaaggugguucaguaugaaaaucucaaauacaccgugaucaucacaguccauacgggcgaccagcaccagguggggaacgagacccaaggaguuacagcugaaauuaccccucaggccucuacaaccgaggcuauccugcccgaauauggcacgcugggccucgaguguuccccuagaaccgggcuggacuucaaugagaugauucuucugacaaugaagaacaaagccuggauggugcaucggcagugguuuuucgaucucccccugccguggaccagcggagccacaaccgaaacgccuacauggaaucgcaaggagcuucuggucaccuuuaagaacgcuugcgcgaaaaagcaagaaguggucgugcucggcucucaggagggggccaugcacacagcucugaccggagccaccgaaauccaaaauuccggcgggacaagcauuuucgccggccaccugaaauguagacucaagauggacaaacuggagcuuaagggaaugucuuacgcuaugugcacgaacaccuuuguucugaagaaagagguguccgaaacacagcauggcaccauccucaucaaggucgaguacaaaggggaagaugugcccuguaagauuccuuucagcacagaggacggacagggcaaagcccacaacgggcggcugaucaccgcgaaucccguugugacgaagaaggaggaacccgucaacauugaggcugaaccuccguucggagaguccaauaucgugauuggcaucggggauaacgcccugaaaaucaauugguauaagaaaggcucuagcauuggaaagauguuugaagccacagcuagaggcgcccgccggauggcuauccuuggggacaccgccugggauuucggauccgugggcgggguucucaacagccugggaaaaaugguccaucagauuuuuggcucugcguacaccgcccuguucuccggggugagcugggugaugaagaucggcauuggaguccuccugacauggaucggccuuaauucuaagaacaccagcauguccuuuucuugcauugcuaucgggaucauuacacuguaucucggagccgugguucaggcuuga

SEQ ID NO: 2161 - RNA, 2037 nt, Artificial Sequence
  derived and/or modified CDS sequence (opt5) from DENV-3 Consensus__SSopt-prME(R186L,A265T)
augaagcggaaaaagaccagccugugccucaugaugauccugcccgccgcucuugccuuccaccugacaucccgggacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucugaccggacuugacuucaaugagaugauucugcucacaaugaagaacaaagccuggauggugcauagacagugguuuuucgaucugccccuuccguggaccagcggcgccacaaccgaaacgccuacauggaaucggaaggagcugcucgucaccuuuaagaacgcucacgcgaaaaagcaagaaguggucgugcuggggucucaggagggagccaugcacacagcucugaccggcaccacagaaauccaaaauuccgggggcacgagcauuuucgccggacaucucaaaugucgccugaagauggacaaacuugagcugaagggcaugucuuacgccaugugcaccaacacauuuguucucaagaaagagguguccgaaacccagcacgggacaauccugaucaaggucgaguacaaaggagaagaugugcccuguaagauuccuuucagcaccgaggacggccaggggaaagcucauaacggaagacugaucacggccaaucccguugugacaaagaaggaggaacccgucaacauugaggcggaaccuccguucggcgaguccaauaucgugauugggaucggcgauaacgcucuuaaaaucaauugguauaagaaaggaucuagcauuggcaagauguuugaagccaccgccagaggggcuagacgcauggccauccucggagacaccgcuugggauuucggcuccguugggggagugcugaacagccugggcaaaaugguccaccagauuuuugggucugccuacacagcgcuguucuccggcgugagcugggugaugaagaucggaauuggcguccugcuuaccuggaucgggcucaauucuaagaacacaagcauguccuuuucuugcauugccaucggaaucauuacgcucuaucugggcgcugugguucaggccuga

SEQ ID NO: 2162 - RNA, 2037 nt, Artificial Sequence
  derived and/or modified CDS sequence (opt5) from DENV-3 Consensus__SSopt-pr(D104A)ME(F108S)
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgccaagagaucuguggcucuggccccucaugucgggaugggacuggacacccggacacaaaccuggaugagcgcugagggcgccuggcgccagguggaaaaaguugagacaugggcgcucagacaccccggcuucaccauccuggcccuuuuucuggcucauuacaucgggacgucccucacacagaagguggucauuuucauccugcuuaugcuggugaccccuucuaugacaaugcgguguguuggagugggcaaccgcgauuuugucgaagggcucagcggagccaccuggguggacgugguccuggagcacggcgggugcguuaccacaauggcuaaaaauaagcccacgcuggauauugagcuccagaaaaccgaagccacacaacuggcgacccuuagaaagcuguguaucgagggaaagauuacaaacaucaccacggacucccggugcccuacacagggcgaagccacccucccggaggaacaggaucagaauuauguguguaaacacaccuacguggaccgcggcugggggaacggaugcggccugagcgggaagggaucucuugucacaugcgcuaaauuccaaugucuggagcccauugagggcaaggugguucaguaugaaaaucucaaauacaccgugaucaucacaguccauacgggggaucagcaccaggugggaaacgagacccaaggcguuacagccgaaauuaccccucaggcuuccacaaccgaggccauccugcccgaauauggcacgcuggggcucgagugcagcccuagaaccggacuggacuuuaaugagaugauucuucugacaaugaagaacaaagccuggauggugcaucggcagugguucuuugaccucccccugccguggaccucuggcgcuacaaccgaaacgccuacauggaaucgcaaggagcuucuggucaccuucaagaacgcgcacgccaaaaagcaagaaguggucgugcucgggucccaggagggagcuaugcacacagcccugaccggcgccaccgaaauccagaauagcgggggcacaucuauuuuugcuggacaucugaaauguagacucaagauggauaaacuggagcuuaagggcauguccuacgccaugugcacgaacaccuucguucugaagaaagaggugagcgaaacacagcacgggaccauccucaucaaggucgaguacaaaggagaagacgugcccuguaagauuccuuuuuccacagaggauggccaagggaaagcgcauaacggacggcugaucaccgcuaaucccguugugacgaagaaggaggaacccgucaacauugaggccgaaccuccguucggcgagucuaauaucgugauugggaucggcgacaacgcccugaaaaucaauugguauaagaaaggaagcuccauuggcaagauguucgaagcuacagccagaggggcucgccggauggccauccuuggagauaccgcgugggacuuuggcagcguugggggagugcucaacucucugggcaaaaugguccaccagauuuucggguccgccuacaccgcucuguuuagcggcgugucuugggugaugaagaucggaauuggcguccuccugacauggaucgggcuuaauagcaagaacaccuccaugucuuucagcugcauugccaucggaaucauuacacuguaucucggcgcugugguucaggccuga

SEQ ID NO: 2163 - RNA, 2037 nt, Artificial Sequence
  derived and/or modified CDS sequence (opt5) from DENV-3 Consensus__SSopt-pr(D104A)ME(R186L,A265T)
augaagcggaaaaagaccagccugugccucaugaugauccugcccgccgcucuugccuuccaccugacaucccgggacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgccaagagaucuguggcucuggccccucaugucgggaugggacuggacacccggacacaaaccuggaugagcgcugagggcgccuggcgccagguggaaaaaguugagacaugggcgcucagacaccccggcuucaccauccuggcccuuuuucuggcucauuacaucgggacgucccucacacagaagguggucauuuucauccugcuuaugcuggugaccccuucuaugacaaugcgguguguuggagugggcaaccgcgauuuugucgaagggcucagcggagccaccuggguggacgugguccuggagcacggcgggugcguuaccacaauggcuaaaaauaagcccacgcuggauauugagcuccagaaaaccgaagccacacaacuggcgacccuuagaaagcuguguaucgagggaaagauuacaaacaucaccacggacucccggugcccuacacagggcgaagccacccucccggaggaacaggaucagaauuauguguguaaacacaccuacguggaccgcggcugggggaacggaugcggccuguucgggaagggaagccuugucacaugcgcuaaauuucaaugucuggagcccauugagggcaaggugguucaguaugaaaaucucaaauacaccgugaucaucacaguccauacgggggaucagcaccaggugggaaacgagacccaaggcguuacagccgaaauuaccccucaggcuucuacaaccgaggccauccugcccgaauauggcacgcuggggcucgagugcuccccucugaccggacuugacuucaaugagaugauucugcucacaaugaagaacaaagccuggauggugcauagacagugguuuuucgaccugccccuuccguggaccagcggcgcuacaaccgaaacgccuacauggaaucggaaggagcugcucgucaccuuuaagaacgcgcacgccaaaaagcaagaaguggucgugcuggggucucaggagggagcuaugcacacagcccugaccggcaccacagaaauccaaaauuccgggggcacgagcauuuucgccggacaucucaaaugucgccugaagauggauaaacuugagcugaagggcaugucuuacgcuaugugcaccaacacauuuguucucaagaaagagguguccgaaacccagcacgggacaauccugaucaaggucgaguacaaaggagaagacgugcccuguaagauuccuuucagcaccgaggauggccaggggaaagcccauaacggaagacugaucacggcgaaucccguugugacaaagaaggaggaacccgucaacauugaggcugaaccuccguucggcgaguccaauaucgugauugggaucggcgacaacgcccuuaaaaucaauugguauaagaaaggaucuagcauuggcaagauguuugaagccaccgcuagaggggccagacgcauggcuauccucggagauaccgccugggacuucggcuccguugggggagugcugaacagccugggcaaaaugguccaccagauuuuugggucugcguacacagcccucuucuccggcgugagcugggugaugaagaucggaauuggcguccugcuuaccuggaucgggcucaauucuaagaacacaagcauguccuuuucuugcauugcuaucggaaucauuacgcuguaucugggcgccgugguucaggcuuga

SEQ ID NO: 2164 - RNA, 2037 nt, Artificial Sequence
  derived and/or modified CDS sequence (opt5) from DENV-3 Consensus__SSopt-pr(D104A)ME(F108S,R186L,A265T)
augaagcggaaaaagaccagccugugccucaugaugauccugcccgccgcucuugccuuccaccugacaucccgggacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgccaagagaucuguggcucuggccccucaugucgggaugggacuggacacccggacacaaaccuggaugagcgcugagggcgccuggcgccagguggaaaaaguugagacaugggcgcucagacaccccggcuucaccauccuggcccuuuuucuggcucauuacaucgggacgucccucacacagaagguggucauuuucauccugcuuaugcuggugaccccuucuaugacaaugcgguguguuggagugggcaaccgcgauuuugucgaagggcucagcggagccaccuggguggacgugguccuggagcacggcgggugcguuaccacaauggcuaaaaauaagcccacgcuggauauugagcuccagaaaaccgaagccacacaacuggcgacccuuagaaagcuguguaucgagggaaagauuacaaacaucaccacggacucccggugcccuacacagggcgaagccacccucccggaggaacaggaucagaauuauguguguaaacacaccuacguggaccgcggcugggggaacggaugcggccugagcgggaagggaucucuugucacaugcgcuaaauuccaaugucuggagcccauugagggcaaggugguucaguaugaaaaucucaaauacaccgugaucaucacaguccauacgggggaucagcaccaggugggaaacgagacccaaggcguuacagccgaaauuaccccucaggcuuccacaaccgaggccauccugcccgaauauggcacgcuggggcucgagugcagcccucugaccggacuugacuuuaaugagaugauucugcucacaaugaagaacaaagccuggauggugcauagacagugguucuuugaccugccccuuccguggaccucuggcgcuacaaccgaaacgccuacauggaaucggaaggagcugcucgucaccuucaagaacgcgcacgccaaaaagcaagaaguggucgugcuggggucccaggagggagcuaugcacacagcccugaccggcaccacagaaauccagaauagcgggggcacgucuauuuuugccggacaucucaaaugucgccugaagauggauaaacuugagcugaagggcauguccuacgcuaugugcaccaacacauucguucucaagaaagaggugagcgaaacccagcacgggacaauccugaucaaggucgaguacaaaggagaagacgugcccuguaagauuccuuuuuccaccgaggauggccaagggaaagcccauaacggaagacugaucacggcgaaucccguugugacaaagaaggaggaacccgucaacauugaggcugaaccuccguucggcgagucuaauaucgugauugggaucggcgacaacgcccuuaaaaucaauugguauaagaaaggaagcuccauuggcaagauguucgaagccaccgcuagaggggccagacgcauggcuauccucggagauaccgccugggacuuuggcagcguugggggagugcugaacucucugggcaaaaugguccaccagauuuucggguccgcguacacagcccucuuuagcggcgugucuugggugaugaagaucggaauuggcguccugcuuaccuggaucgggcugaauagcaagaacacauccaugucuuucagcugcauugcuaucggaaucauuacgcucuaucugggcgccgugguucaggcuuga

SEQ ID NO: 2165 - RNA, 2016 nt, Artificial Sequence
  derived and/or modified CDS sequence (opt5) from DENV-3 Consensus__SSopt-prMEdel101-107,(R99P,F108N)
augaagcgcaaaaagaccagccugugccucaugaugauccugcccgccgcucuugccuuccaccugacaucccgggacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucccggcaacgggaagggaagccuggucacaugcgccaaauuccaaugccuugagccuauugagggcaaggugguucaguaugaaaaucugaaauacaccgugaucaucacaguccauacgggggaccagcaccaggugggaaacgagacccaaggcguuacagcugaaauuacaccccaggccucuaccaccgaggcuauccucccugaauaugggacgcugggacuggaguguucccccagaaccggccucgacuuuaaugagaugauucugcuuacaaugaagaacaaagccuggauggugcauagacagugguucuuugaucugccgcucccuuggaccagcggcgccacaaccgaaacgcccacauggaaucggaaggagcugcuugucaccuucaagaacgcucacgcgaaaaagcaagaaguggucgugcuggggucucaggagggagccaugcacacagcucucaccggcgccaccgaaauccaaaauuccgggggaacaagcauuuuugccggccaucugaaaugccgccugaagauggacaaacucgagcugaaggggaugucuuacgcuauguguacgaacaccuucguucuuaagaaagagguguccgaaacacagcacggcaccauccugaucaaggucgaguacaaaggagaagaugugccuugcaagauucccuuuagcacagaggacggccaggggaaagcccauaacggaagacucaucaccgcgaaucccguugugacgaagaaggaggaaccugucaacauugaggcugaaccgcccuucggcgaguccaauaucgugauugggaucggagauaacgcccugaaaaucaauugguauaagaaaggcucuagcauugggaagauguucgaagccacagcucggggcgccagacgcauggcuauccugggagacaccgccugggauuuuggcuccguugggggagugcuuaacagccucggcaaaaugguccaccagauuuucgggucugcguacaccgcccuguuuuccggagugagcugggugaugaagaucggcauugggguccugcucacauggaucggccuuaauucuaagaacaccagcauguccuucucuuguauugcuaucggaaucauuacacuguaucugggcgccgugguucaggcuuga

SEQ ID NO: 2166 - RNA, 2037 nt, Artificial Sequence
  derived and/or modified CDS sequence (opt5) from DENV-3 Consensus__SSopt-prMEdelstem_TM-JEV
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccuagaaccggacuggacuucaaugagaugauucuucugacaaugaagaacaaagccuggauggugcaucggcagugguuuuucgaucucccccugccguggaccagcggcgccacaaccgaaacgccuacauggaaucgcaaggagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaaauguagacucaagauggacaaacuggagcuuaagggcaugucuuacgcuaugugcacgaacaccuuuguucugaagaaagagguguccgaaacacagcacgggaccauccucaucaaggucgaguacaaaggagaagaugugcccuguaagauuccuuucagcacagaggacggccaggggaaagcccauaacggacggcugaucaccgcgaaucccguugugacgaagaaggaggaacccgucaacauugaggcugaaccuccguucggcgaguccaauaucgugauugggaucggcgauaacgcccugaaaaucaauugguauaagaaaggaucuacacuuggcaaggccuuuagcaccacccucaaaggggcucagagacuggccgcucugggagacacagccugggauuucggcuccauugggggaguguuuaacagcaucggccgcgcgguucaccaggucuucgggggcgccuuucggacccucuucggaggcaugucuuggauuacacaggggcugaugggagcccuucugcucuggaugggcgugaaugcuagagaccgcuccaucgcucuggccuuucuggcgaccgggggagugcuugucuuccucgccacgaacgugcaugcuuga

SEQ ID NO: 2167 - RNA, 2037 nt, Artificial Sequence
  derived and/or modified CDS sequence (opt5) from DENV-3 Consensus__SSopt-pr(D104A)MEdelstem_TM,(F108S)-JEV
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgccaagagaucuguggcucuggccccucaugucgggaugggacuggacacccggacacaaaccuggaugagcgcugagggcgccuggcgccagguggaaaaaguugagacaugggcgcucagacaccccggcuucaccauccuggcccuuuuucuggcucauuacaucgggacgucccucacacagaagguggucauuuucauccugcuuaugcuggugaccccuucuaugacaaugcgguguguuggagugggcaaccgcgauuuugucgaagggcucagcggagccaccuggguggacgugguccuggagcacggcgggugcguuaccacaauggcuaaaaauaagcccacgcuggauauugagcuccagaaaaccgaagccacacaacuggcgacccuuagaaagcuguguaucgagggaaagauuacaaacaucaccacggacucccggugcccuacacagggcgaagccacccucccggaggaacaggaucagaauuauguguguaaacacaccuacguggaccgcggcugggggaacggaugcggccugagcgggaagggaucucuugucacaugcgcuaaauuccaaugucuggagcccauugagggcaaggugguucaguaugaaaaucucaaauacaccgugaucaucacaguccauacgggggaucagcaccaggugggaaacgagacccaaggcguuacagccgaaauuaccccucaggcuuccacaaccgaggccauccugcccgaauauggcacgcuggggcucgagugcagcccuagaaccggacuggacuuuaaugagaugauucuucugacaaugaagaacaaagccuggauggugcaucggcagugguucuuugaccucccccugccguggaccucuggcgcuacaaccgaaacgccuacauggaaucgcaaggagcuucuggucaccuucaagaacgcgcacgccaaaaagcaagaaguggucgugcucgggucccaggagggagcuaugcacacagcccugaccggcgccaccgaaauccagaauagcgggggcacaucuauuuuugcuggacaucugaaauguagacucaagauggauaaacuggagcuuaagggcauguccuacgccaugugcacgaacaccuucguucugaagaaagaggugagcgaaacacagcacgggaccauccucaucaaggucgaguacaaaggagaagacgugcccuguaagauuccuuuuuccacagaggauggccaagggaaagcgcauaacggacggcugaucaccgcuaaucccguugugacgaagaaggaggaacccgucaacauugaggccgaaccuccguucggcgagucuaauaucgugauugggaucggcgacaacgcccugaaaaucaauugguauaagaaaggaagcacacuuggcaaggcuuucuccaccacccucaaaggggcccagagacuggcugcccugggagauacagcgugggacuuuggcagcauugggggaguguucaacucuaucggccgcgccguucaccaggucuuugggggcgcuuuccggacccucuuuggaggcauguccuggauuacacaggggcugaugggagcccuucugcucuggaugggcgugaaugcuagagaucgcagcaucgcccuggcguuccuggccaccgggggagugcuugucuuucucgcuacgaacgugcaugccuga

SEQ ID NO: 2168 - RNA, 2037 nt, Artificial Sequence
  derived and/or modified CDS sequence (opt5) from DENV-3 Consensus__SSopt-pr(D104A)MEdelstem_TM,(R186L,A265T)-JEV
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgccaagagaucuguggcucuggccccucaugucgggaugggacuggacacccggacacaaaccuggaugagcgcugagggcgccuggcgccagguggaaaaaguugagacaugggcgcucagacaccccggcuucaccauccuggcccuuuuucuggcucauuacaucgggacgucccucacacagaagguggucauuuucauccugcuuaugcuggugaccccuucuaugacaaugcgguguguuggagugggcaaccgcgauuuugucgaagggcucagcggagccaccuggguggacgugguccuggagcacggcgggugcguuaccacaauggcuaaaaauaagcccacgcuggauauugagcuccagaaaaccgaagccacacaacuggcgacccuuagaaagcuguguaucgagggaaagauuacaaacaucaccacggacucccggugcccuacacagggcgaagccacccucccggaggaacaggaucagaauuauguguguaaacacaccuacguggaccgcggcugggggaacggaugcggccuguucgggaagggaagccuugucacaugcgcuaaauuucaaugucuggagcccauugagggcaaggugguucaguaugaaaaucucaaauacaccgugaucaucacaguccauacgggggaucagcaccaggugggaaacgagacccaaggcguuacagccgaaauuaccccucaggcuucuacaaccgaggccauccugcccgaauauggcacgcuggggcucgagugcuccccucugaccggacuugacuucaaugagaugauucugcucacaaugaagaacaaagccuggauggugcauagacagugguuuuucgaccugccccuuccguggaccagcggcgcuacaaccgaaacgccuacauggaaucggaaggagcugcucgucaccuuuaagaacgcgcacgccaaaaagcaagaaguggucgugcuggggucucaggagggagcuaugcacacagcccugaccggcaccacagaaauccaaaauuccgggggcacgagcauuuucgccggacaucucaaaugucgccugaagauggauaaacuugagcugaagggcaugucuuacgcuaugugcaccaacacauuuguucucaagaaagagguguccgaaacccagcacgggacaauccugaucaaggucgaguacaaaggagaagacgugcccuguaagauuccuuucagcaccgaggauggccaggggaaagcccauaacggaagacugaucacggcgaaucccguugugacaaagaaggaggaacccgucaacauugaggcugaaccuccguucggcgaguccaauaucgugauugggaucggcgacaacgcccuuaaaaucaauugguauaagaaaggaucuacccucggcaaggccuuuagcaccacacugaaaggggcucagcggcuggccgcucucggagauaccgccugggacuucggcuccauugggggaguguuuaacagcaucggcagagcgguucaccaggucuucgggggcgccuuucgcacacuguucggaggcaugucuuggauuacgcaggggcuuaugggagcucugcuccuguggaugggcgugaaugcccgggauagauccaucgcucuggccuuucuugcgaccgggggagugcucgucuuccuggccacaaacgugcaugcuuga

SEQ ID NO: 2169 - RNA, 2037 nt, Artificial Sequence
  derived and/or modified CDS sequence (opt5) from DENV-3 Consensus__SSopt-pr(D104A)MEdelstem_TM,(F108S,R186L,A265T)-JEV
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgccaagagaucuguggcucuggccccucaugucgggaugggacuggacacccggacacaaaccuggaugagcgcugagggcgccuggcgccagguggaaaaaguugagacaugggcgcucagacaccccggcuucaccauccuggcccuuuuucuggcucauuacaucgggacgucccucacacagaagguggucauuuucauccugcuuaugcuggugaccccuucuaugacaaugcgguguguuggagugggcaaccgcgauuuugucgaagggcucagcggagccaccuggguggacgugguccuggagcacggcgggugcguuaccacaauggcuaaaaauaagcccacgcuggauauugagcuccagaaaaccgaagccacacaacuggcgacccuuagaaagcuguguaucgagggaaagauuacaaacaucaccacggacucccggugcccuacacagggcgaagccacccucccggaggaacaggaucagaauuauguguguaaacacaccuacguggaccgcggcugggggaacggaugcggccugagcgggaagggaucucuugucacaugcgcuaaauuccaaugucuggagcccauugagggcaaggugguucaguaugaaaaucucaaauacaccgugaucaucacaguccauacgggggaucagcaccaggugggaaacgagacccaaggcguuacagccgaaauuaccccucaggcuuccacaaccgaggccauccugcccgaauauggcacgcuggggcucgagugcagcccucugaccggacuugacuuuaaugagaugauucugcucacaaugaagaacaaagccuggauggugcauagacagugguucuuugaccugccccuuccguggaccucuggcgcuacaaccgaaacgccuacauggaaucggaaggagcugcucgucaccuucaagaacgcgcacgccaaaaagcaagaaguggucgugcuggggucccaggagggagcuaugcacacagcccugaccggcaccacagaaauccagaauagcgggggcacgucuauuuuugccggacaucucaaaugucgccugaagauggauaaacuugagcugaagggcauguccuacgcuaugugcaccaacacauucguucucaagaaagaggugagcgaaacccagcacgggacaauccugaucaaggucgaguacaaaggagaagacgugcccuguaagauuccuuuuuccaccgaggauggccaagggaaagcccauaacggaagacugaucacggcgaaucccguugugacaaagaaggaggaacccgucaacauugaggcugaaccuccguucggcgagucuaauaucgugauugggaucggcgacaacgcccuuaaaaucaauugguauaagaaaggaagcacccucggcaaggccuucuccaccacacugaaaggggcucagcggcuggccgcucucggagauaccgccugggacuuuggcagcauugggggaguguucaacucuaucggcagagcgguucaccaggucuuugggggcgccuuccgcacacuguuuggaggcauguccuggauuacgcaggggcuuaugggagcucugcuccuguggaugggcgugaaugcccgggauagaagcaucgcucuggccuuccuugcgaccgggggagugcucgucuuucuggccacaaacgugcaugcuuga

SEQ ID NO: 2170 - RNA, 2037 nt, Artificial Sequence
  derived and/or modified CDS sequence (opt5) from DENV-3 Consensus__SSopt-prMEdelstem_TM,(H259N)-JEV
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccuagaaccggacuggacuucaaugagaugauucuucugacaaugaagaacaaagccuggauggugcaucggcagugguuuuucgaucucccccugccguggaccagcggcgccacaaccgaaacgccuacauggaaucgcaaggagcuucuggucaccuuuaagaacgcucacgcgaaaaagcaagaaguggucgugcucgggucucaggagggagccaugaauacagcucugaccggcgccaccgaaauccagaacuccgggggcacaagcauuuucgccggacaccugaaauguagacucaagauggacaaacuggagcuuaagggcaugucuuacgcuaugugcacgaacaccuuuguucugaagaaagagguguccgaaacacagcaugggaccauccucaucaaggucgaguacaaaggagaagaugugcccuguaagauuccuuucagcacagaggacggccaagggaaagcccacaauggacggcugaucaccgcgaaccccguugugacgaagaaggaggaacccgucaauauugaggcugaaccuccguucggcgaguccaacaucgugauugggaucggcgauaaugcccugaaaaucaacugguauaagaaaggaucuacacuuggcaaggccuuuagcaccacccucaaaggggcucagagacuggccgcucugggagacacagccugggauuucggcuccauugggggaguguuuaauagcaucggccgcgcgguucaucaggucuucgggggcgccuuucggacccucuucggaggcaugucuuggauuacacaggggcugaugggagcccuucugcucuggaugggcgugaacgcuagagaccgcuccaucgcucuggccuuucuggcgaccgggggagugcuugucuuccucgccacgaaugugcacgcuuga

SEQ ID NO: 2171 - RNA, 2037 nt, Artificial Sequence
  derived and/or modified CDS sequence (opt5) from DENV-3 Consensus__SSopt-prMEdelstem_TM,(R186L,A265T)-JEV
augaagcggaaaaagaccagccugugccucaugaugauccugcccgccgcucuugccuuccaccugacauccagagacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucgcggcugggggaacggaugcggccuguucgggaagggaagccuugucacaugcgccaaauuucaaugucuggagcccauugagggcaaggugguucaguaugaaaaucucaaauacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucugaccggacuugacuucaaugagaugauucugcucacaaugaagaacaaagccuggauggugcauagacagugguuuuucgaucugccccuuccguggaccagcggcgccacaaccgaaacgccuacauggaaucggaaggagcugcucgucaccuuuaagaacgcucacgcgaaaaagcaagaaguggucgugcuggggucucaggagggagccaugcacacagcucugaccggcaccacagaaauccaaaauuccgggggcacgagcauuuucgccggacaucucaaaugucgccugaagauggacaaacuugagcugaagggcaugucuuacgccaugugcaccaacacauuuguucucaagaaagagguguccgaaacccagcacgggacaauccugaucaaggucgaguacaaaggagaagaugugcccuguaagauuccuuucagcaccgaggacggccaggggaaagcucauaacggaagacugaucacggccaaucccguugugacaaagaaggaggaacccgucaacauugaggcggaaccuccguucggcgaguccaauaucgugauugggaucggcgauaacgcucuuaaaaucaauugguauaagaaaggaucuacccucggcaaggccuuuagcaccacacugaaaggggcccagcggcuggcugcccucggagacaccgcuugggauuucggcuccauugggggaguguuuaacagcaucggcagagccguucaccaggucuucgggggcgcguuucgcacacuguucggaggcaugucuuggauuacgcaggggcuuaugggagcccugcuccuguggaugggcgugaaugcucgggacagauccaucgcccuggcuuuucuugccaccgggggagugcucgucuuccuggcgacaaacgugcaugccuga

SEQ ID NO: 2172 - RNA, 2016 nt, Artificial Sequence
  derived and/or modified CDS sequence (opt5) from DENV-3 Consensus__SSopt-prMEdelstem_TM,del101-107,(R99P,F108N)-JEV
augaagcgcaaaaagaccagccugugccucaugaugauccugcccgccgcucuugccuuccaccugacaucccgggacggcgagccucgcaugauuguggggaaaaacgaaagaggaaagucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaagagaucuguggcccuggcuccucaugucgggaugggacuggauacccggacacaaaccuggaugagcgccgagggcgcuuggcgccagguggaaaaaguugagacaugggcccucagacaccccggcuucaccauccuggcgcuuuuucuggcccauuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaaaaauaagcccacgcuggacauugagcuccagaaaaccgaagcuacacaacuggccacccuuagaaagcuguguaucgagggaaagauuacaaacaucaccacggauucccggugcccuacacagggcgaagcgacccucccggaggaacaggaccagaauuauguguguaaacacaccuacguggaucccggcaacgggaagggaagccuggucacaugcgccaaauuccaaugccuugagccuauugagggcaaggugguucaguaugaaaaucugaaauacaccgugaucaucacaguccauacgggggaccagcaccaggugggaaacgagacccaaggcguuacagcugaaauuacgccccaggccucuacaaccgaggcuauccucccugaauaugggacgcugggacuggaguguucccccagaaccggccucgacuuuaaugagaugauucugcuuacaaugaagaacaaagccuggauggugcauagacagugguucuuugaucugccgcucccuuggaccagcggcgccacaaccgaaacgcccacauggaaucggaaggagcugcuugucaccuucaagaacgcucacgcgaaaaagcaagaaguggucgugcuggggucucaggagggagccaugcacacagcucucaccggcgccaccgaaauccaaaauuccgggggaacaagcauuuuugccggccaucugaaaugccgccugaagauggacaaacucgagcugaaggggaugucuuacgcuauguguacgaacaccuucguucuuaagaaagagguguccgaaacacagcacggcaccauccugaucaaggucgaguacaaaggagaagaugugccuugcaagauucccuuuagcacagaggacggccaggggaaagcccauaacggaagacucaucaccgcgaaucccguugugacgaagaaggaggaaccugucaacauugaggcugaaccgcccuucggcgaguccaauaucgugauugggaucggagauaacgcccugaaaaucaauugguauaagaaaggcucuacacuggggaaggccuucagcaccacccuuaaaggcgcucagcggcucgccgcucugggagacacagccugggauuuuggcuccauugggggaguguucaacagcaucggcagagcgguucaccaggucuuugggggagccuuccgcacccuguuuggcgggaugucuuggauuacacagggccucaugggagcucugcuucuguggaugggcgugaaugcccgggacagauccaucgcucucgccuuccuggcgaccgggggagugcuggucuuucuugccaccaacgugcaugcuuga

SEQ ID NO: 2173 - RNA, 3081 nt, Artificial Sequence
  derived and/or modified CDS sequence (opt5) from DENV-3 Consensus__SSc-prME-NS1
augaccagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcgccagguggaaaaaguugagacaugggcccuccggcaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcgacccucccggaggaacaggaccagaauuauguguguaaacacaccuacguggaucggggcugggggaacggaugcggccuguucgggaagggaagccuugucacaugcgccaaguuucaaugucuggagcccauugagggcaaagugguucaguaugaaaaucucaaguacaccgugaucaucacaguccauacgggggaccagcaccaggugggaaacgagacccaaggcguuacagcugaaauuaccccucaggccucuacaaccgaggcuauccugcccgaauauggcacgcuggggcucgagugcuccccucgcaccggacuggacuucaaugagaugauucuucugacaaugaaaaacaaggccuggauggugcauagacagugguuuuucgaucucccccugccguggaccagcggcgccacaaccgaaacgccuacauggaaucggaaagagcuucuggucaccuuuaagaacgcucacgcgaaaaagcaagaaguggucgugcucgggucucaggagggagccaugcacacagcucugaccggcgccaccgaaauccaaaauuccgggggcacaagcauuuucgccggacaucugaagugucgccucaaaauggacaagcuggagcuuaaaggcaugucuuacgcuaugugcacgaacaccuuuguucugaagaaagagguguccgaaacacagcacgggaccauccucaucaaggucgaguacaagggagaagaugugcccuguaaaauuccuuucagcacagaggacggccaggggaaggcccauaacggaagacugaucaccgcgaaucccguugugacgaaaaaggaggaacccgucaacauugaggcugaaccuccguucggcgaguccaauaucgugauugggaucggcgauaacgcccugaaaaucaauugguauaagaagggaucuagcauuggcaaaauguuugaagccacagcuagaggggcccggcgcauggcuauccuuggagacaccgccugggauuucggcuccguugggggagugcucaacagccugggcaagaugguccaccagauuuuugggucugcguacaccgcccuguucuccggcgugagcugggugaugaaaaucggaauuggcguccuccugacauggaucgggcuuaauucuaagaacaccagcauguccuuuucuugcauugcuaucggaaucauuacacuguaucucggcgccgugguucaggcugacauggggugugugaucaauuggaaaggaaaggagcugaagugcggcagcgggauuuucgucacgaacgaggugcauaccuggacagaacaguacaaauuucaagccgauucccccaagcggcuggcgaccgccaucgcuggcgccugggagaauggaguuuguggcauuagaagcacaacccgcauggaaaaccuucucuggaaacagaucgcuaaugagcugaacuauauccugugggaaaauaacauuaagcucacgguggucgugggggacaucauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugucuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaaccaucgccccggauaucacacccaaacggccggcccuuggcaccuugggaagcuggagcucgacuuuaauuacugcgagggaacaaccguugugaucacagaaaacuguggcacccggggccccucucugagaacaaccacggucuccgggaaacugauccaugaguggugcugucgcagcugcacccuuccgccucuccgguauaugggagaagauggcuguugguacgggauggagauuagacccaucucugaaaaggaggagaauauggugaaaucccugguuagcgcguga

SEQ ID NO: 2174 - RNA, 1824 nt, Artificial Sequence
  derived and/or modified CDS sequence (opt5) from DENV-3 Consensus__SSm-EdelTM-linker-ferritin
augacccagaagguggucaucuucauucugcucaugcugguuacacccagcaugacgaugagaugcgugggcguggggaaccgggacuuugucgagggacuuuccggcgccaccuggguggauguugugcuggaacacgggggaugugucacaaccauggcuaaaaauaagccuacacucgacaucgagcugcagaaaaccgaagccacacagcuugcgacccugcgcaagcucugcauugagggcaaaaucacgaacauuaccacagauucuagauguccgacccagggggaagcuacacugcccgaggagcaggaccaaaauuacgugugcaagcauaccuauguugaucggggauggggcaacggcugugggcuguucggaaagggcagccucgugacgugcgccaaauuucagugucuggaaccuaucgaggggaaggucgugcaguacgaaaaucuuaaauauacagugaucauuaccguccacacaggagaccagcaucaaguuggcaacgagacccagggggugaccgccgagaucacaccccaggcuuccacgaccgaagccauucugccugaguacggaacacucggccuggaaugcucuccccgcaccggccuugauuucaaugagaugauccugcucacaaugaagaacaaggcuuggauggugcacagacagugguuuuucgaccugccucugccguggaccagcggggccacgacagaaacccccaccuggaaucggaaagagcuccuggucacauuuaagaacgcgcaugccaaaaagcaagaggugguugugcuuggaucccaggaaggcgcuaugcacaccgcccugacaggggcuacggagauucaaaauucuggaggcaccagcaucuucgccgggcaccucaaaugucgccugaagauggauaaacuugaacugaagggaauguccuaugcgaugugcacaaacaccuuuguccucaaaaaggaggugagcgaaacacaacauggcaccauucugaucaagguugaguacaaaggcgaggacgugccuuguaagauccccuucucuacggaagaugggcagggaaaagcccacaauggcagacugauuaccgcuaacccugucgugacaaagaaagaggaacccgucaauaucgaggccgaaccgccuuuuggggaguccaacauugugaucggaauuggcgacaacgcucucaagaucaauugguauaagaaagggagcucuaucggcaagauguucgaggccaccgcccggggagcucgcagaauggcgauucugggcgauacagccugggacuuuggguccagcggaggcgacaucauuaaacuucugaacgaacagguuaauaaggagaugcagucuuccaaccucuacaugagcauguccucuuggugcuacacccauagccuggauggggcuggacuuuuccuguucgaccacgccgccgaagaguaugagcacgcuaaaaagcucaucauuuuucugaaugaaaacaaugugcccguccaacugacguccaucagcgccccugagcauaaguucgaaggccucacacagaucuuucagaaagcguacgagcacgaacagcauauuucugaguccaucaacaauauuguggaucacgcuaucaagagcaaagaccaugccaccuucaacuuucugcaaugguauguugccgagcagcacgaagaggaagugcuuuucaaggauauucuggacaaaaucgagcucauugggaaugaaaaccacggccuguaccuggcugaucaguaugucaagggaaucgccaagucucggaaaagcuga

SEQ ID NO: 2175 - RNA, 1821 nt, Artificial Sequence
  derived and/or modified CDS sequence (opt5) from DENV-3 Consensus__SStPA-WHbcAg-linker-EdelTM
auggacgccaugaagagaggccugugcugugugcuccugcuuugcggggcugucuucguugauagcgugaccggaauggacaucgaucccuacaaagaguuuggcuccucuuaucagcugcucaacuuccugccucuugacuuuuucccggaucugaaugcccucguggacacagcgacggcucuguacgaagaggaacugaccgggcgggagcacuguagcccccaucacacagccauucgccaagcccucgucugcugggaugaacugaccaaacuuaucgcuuggauguccucuaacauuacaagcgaacaggugagaaccaucauuguuaaucaugugaacgacacauggggacugaaaguccggcagucccucugguuucaccugucuugucuuaccuucggccagcauacggugcaagaguuucugguuagcuucgggguguggauccgcaccccugcccccuauagaccucccaaugcuccuauccucuccacacugccggaacacaccgucauuugcggaggcggcgggagcggaggcgggggaaugcggugugugggcguggggaaccgcgauuuugucgagggacugucuggcgccacauggguugacguggugcucgaacacggcgggugcgucaccacgauggcgaagaauaaacccacacuggauaucgagcuucagaagaccgaggccacacagcuggcuacccucagaaagcuguguauugaaggaaaaaucaccaacauuacaacggacucccggugcccuacccagggcgaggccacacuucccgaggagcaagaucagaauuacguguguaagcauaccuauguugaccgcggguggggaaacggcugcgggcuguucggaaaaggcagccucgugacaugcgcuaaguuucagugucuggaaccuaucgagggcaaagucgugcaguacgagaaucugaaguauaccguuauuaucacggugcacacaggggaccaacaucaggucggaaacgaaacccagggcgugaccgccgagaucacaccccaagcgucuaccacagaagccauucucccggaguacgggacgcugggacuugaaugcuccccuagaaccggccuggauuucaaugagaugauccuccugacaaugaagaacaaggcuuggaugguccaccggcagugguuuuucgaccuuccccugccuuggaccagcggggccacaaccgagacgcccaccuggaaucgcaaggaacuccuggugacauucaaaaacgcucacgccaagaaacaggagguugugguccugggcucucaggaaggagccaugcauaccgcucucacaggcgcgaccgagauucaaaacuccgggggaacgagcaucuuugccggccaccugaaguguagacuuaaaauggauaagcuggaacucaaggggauguccuacgcuaugugcacaaauaccuucgugcugaaaaaggagguuucugagacacagcauggaaccauucugaucaaaguggaauauaagggcgaggacguccccuguaaaaucccuuuuagcaccgaagaugggcagggcaaggcccacaacggacggcuuauuacagccaauccgguggugacgaagaaagaggagcccguuaacaucgaagcugagccucccuucggcgaauccaauauugucaucgggauuggagacaacgcccucaagaucaauugguacaaaaagggcagcucuaucgggaaaauguuugaggcgaccgcucgcggagccagacggauggccauucugggcgauacagcuugggacuucggguccuga

SEQ ID NO: 2176 - RNA, 75 nt, Artificial Sequence
  derived and/or modified CDS sequence (opt6) from Homo sapiens__SigSeq(TPA)/SStPA
auggaugcaaugaaaagaggauuauguuguguauuauuauuauguggagcaguauuuguagauagugugacaggg

SEQ ID NO: 2177 - RNA, 489 nt, Artificial Sequence
  derived and/or modified CDS sequence (opt6) from Helicobacter pylori J99__Ferritin
gacauaauaaaacuacuaaacgaacaaguaaacaaagaaaugcaaucaagcaaccucuacaugucaaugucaucauggugcuacacacacucacuagacggagcaggacuauucuuauucgaccacgcagcagaagaauacgaacacgcaaaaaaacuaauaauauuccuaaacgaaaacaacguaccaguacaacuaacaucaauaucagcacccgaacacaaauucgaaggacuaacacaaauauuccaaaaagcauacgaacacgaacaacacauaucagaaucaauaaacaacauaguagaccacgcaauaaaaucaaaagaccacgcaacauucaacuucuuacaaugguacguagcagaacaacacgaagaagaaguacuauucaaagacauacuagacaaaauagaacuaauaggaaacgaaaaccauggacuauaccuagcagaccaauacgucaaaggaauagcaaaaucaagaaaauca

SEQ ID NO: 2178 - RNA, 450 nt, Artificial Sequence
  derived and/or modified CDS sequence (opt6) from Woodchuck hepatitis virus__WHbcAg
auggacauagacccauacaaagaauucggaucaucauaccaacuacuaaacuuccuaccacuagacuucuuuccagaccuaaacgcccuaguagacacagcaacagcauuauacgaagaagaacuaacaggaagagaacacugcucaccacaccacacagcaauaagacaagcacuaguaugcugggacgaacuaacaaaacuaauagcauggaugucaucaaacauaacaucagaacaaguaagaacaauaauaguaaaccacguaaacgacacauggggauuaaaaguaagacaaucauuaugguuccaccuauccugccuaacauucggacaacacacaguacaagaauuccuaguaucauucggaguauggauaagaacaccagcaccauacagaccaccaaacgcaccaauacuaucaacacuaccagaacacacaguaauaugc

SEQ ID NO: 2179 - RNA, 303 nt, Artificial Sequence
  derived and/or modified CDS sequence (opt6) from Japanese encephalitis virus__Cterm-JEV/JEV
ggaaguacauuaggaaaagcauuuucaacaacauuaaaaggagcacaaagauuagcagcauuaggagauacagcaugggauuuuggaaguauaggaggaguauuuaauucaauaggaagagcaguacaucaaguauuuggaggagcauuuagaacauuauuuggaggaaugaguuggauaacacaaggauuaaugggagcauuauuauuauggaugggaguaaaugcaagagauagaaguauagcauuagcauuuuuagcaacaggaggaguauuaguauuuuuagcaacaaauguacaugca

SEQ ID NO: 2180 - RNA, 15 nt, Artificial Sequence
  derived and/or modified CDS sequence (opt6) from Artificial__MKRKK
augaagagaaagaag

SEQ ID NO: 2181 - RNA, 9 nt, Artificial Sequence
  derived and/or modified CDS sequence (opt6) from Artificial__Linker(SGG)
aguggaggc

SEQ ID NO: 2182 - RNA, 27 nt, Artificial Sequence
  derived and/or modified CDS sequence (opt6) from Artificial__Linker(G4SG4)
ggggggggggggaguggagggggaggg

SEQ ID NO: 2183 - RNA, 51 nt, Artificial Sequence
  derived and/or modified CDS sequence (opt6) from Foot-and-mouth disease virus__F2A/P2A
aacuuugacuuacuaaaacuagcaggagauguagaaagcaauccaggacca

SEQ ID NO: 2184 - RNA, 300 nt, Artificial Sequence
  derived and/or modified CDS sequence (opt6) from DENV-1 CYD23__C
augaacaaccaaagaaaaaaaacagcaagaccaagcuucaacaugcuaaaaagagcaagaaacagaguaaguacaguaucacaacuagcaaaaagauucagcaaaggacuacuaucaggacaaggaccaaugaaacuaguaauggcauucauagcauuccuaagauuccuagcaauaccaccaacagcaggaauacuagcaagauggggaucauucaaaaaaaacggagcaauaaaaguacuaagaggauucaaaaaagaaauaucaaacaugcuaaacauaaugaacagacgaagaaaa

SEQ ID NO: 2185 - RNA, 342 nt, Artificial Sequence
  derived and/or modified CDS sequence (opt6) from DENV-1 CYD23__C-SSc
augaacaaccaaagaaaaaaaacagcaagaccaagcuucaacaugcuaaaaagagcaagaaacagaguaagcacaguaucacaauuagcaaaacgauucagcaaaggacuacuaucaggacaaggaccaaugaaacuaguaauggcauucauagcauuccuaagauuccuagcaauaccaccaacagcaggaauacuagcaagauggggaucauucaaaaaaaacggagcaauaaaaguacuaagaggauucaaaaaagaaauaucaaacaugcuaaacauaaugaacagaagaagaaaaucaguaacaaugcuacuaaugcuaaugccaacagcacuagca

SEQ ID NO: 2186 - RNA, 273 nt, Artificial Sequence
  derived and/or modified CDS sequence (opt6) from DENV-1 CYD23__pr
uuucacuuaacaacaagaggaggagaaccacauaugauaguaucaaaacaagaaagaggaaaaagucuauuauuuaaaacaagugcaggaguaaauaugugcacacuaauagcaauggacuuaggagaacuaugugaagacacaaugacauauaaaugcccaagaauaacagaagcagaaccagacgauguagacugcuggugcaaugcaacagacacauggguaacauacggaacaugcucacaaacaggagaacacagaagagacaaaaga

SEQ ID NO: 2187 - RNA, 225 nt, Artificial Sequence
  derived and/or modified CDS sequence (opt6) from DENV-1 CYD23__M
agcguagcauuagcaccacacguaggauuaggauuagaaacaagaacagaaacauggaugagcucagaaggagcauggaaacaaauacaaagaguagaaacaugggcacuaagacacccaggauuuacaguaauagcacuauuucuagcacacgcaauaggaacaucaauaacacaaaaaggaauaauauuuauauuacuaaugcuaguaacaccaagcauggca

SEQ ID NO: 2188 - RNA, 498 nt, Artificial Sequence
  derived and/or modified CDS sequence (opt6) from DENV-1 CYD23__prM
uuccacuuaaccacaagaggaggagaaccacacaugauaguaucaaaacaagaaagaggaaaaucauuauuauucaaaacaagcgcaggaguaaacaugugcacauuaauagcaauggacuuaggagaauuaugugaagauacaaugacauauaaauguccaagaauaacagaagcagaaccagacgauguagauugcuggugcaaugcaacagacacauggguaacauauggaacaugcagccaaacgggagaacacagaagagauaaaagaaguguagcauuagcaccacacguaggauuaggauuagaaacaagaacagaaacauggaugagcucagaaggagcauggaaacaaauacaaagaguagaaacaugggcacuaagacacccaggauuuacaguaauagcauuauuucuagcacacgcaauaggaacaaguauaacacaaaaaggcauaauauuuauauuacuaaugcuaguaacaccaaguauggca

SEQ ID NO: 2189 - RNA, 1485 nt, Artificial Sequence
  derived and/or modified CDS sequence (opt6) from DENV-1 CYD23__E
augcgauguguaggaauaggaaguagagauuuuguagaaggucuaagcggagcaacauggguagacguaguacuagaacauggaucauguguaacuacuauggcaaaagauaaaccuacauuagacauagaguuacuaaaaacagaaguaacuaauccagcaguauuacgaaaacucugcauagaagcaaaaauaucaaacacuacaacagauucaagguguccaacacaaggagaagcaacucuagucgaagaacaagacgcaaacuucguaugcagaagaacauuuguggauagaggauggggaaaugguuguggccuauuuggaaaaggaucauuaauaacaugugcaaaauuuaaauguguaacaaaacuugaaggaaaaauaguacaauacgaaaaucuuaaauauucuguuauaguuacaguacacacaggagaucaacaccaaguaggaaacgagucaacagaacauggaacuacugcaacaauuaccccacaagcuccaacaacagaaauccaauugacugauuacggagcauuaacauuagauuguucaccaagaacagguuuagacuuuaaugaaaugguauuacuaacaaugaaagaaaaaucaugguuaguacauaaacaaugguuuuuagaucuaccauuacccuggacaucaggagccucaacaagucaagaaacauggaauagacaagauuugcuaguaacauucaaaacagcacaugcaaagaaacaagaaguuguaguguuaggaagucaagaaggagcaaugcacacagcuuuaacaggagccacagaaauacaaacaucaggaacuacaacaauuuucgcaggacauuuaaaaugucgacuaaaaauggacaaauuaacacuuaaaggcaugucauauguaauguguacaggaaguuuuaaauuagaaaaagaaguagcagaaacccaacacggaacaguccuaguacaaauaaaauaugaagggacugaugcacccugcaaaauaccuuucucaacacaggaugaaaaaggaguaacacaaaacgguagacuaauaacagcaaacccaauuguaacagacaaagaaaaaccuguaaauauagaagcagaaccaccguucggagaaucauauauuguaauaggagccggugaaaaagcauuaaaacuaaguugguucaaaaagggcucaaguaucggaaaaauguuugaagcaacagcaagaggcgcaagaagaauggcaauacucggugauacagcaugggauuucggaaguauaggaggaguauucacuucaguaggaaaauuaguacaucaaauuuuuggaacagcauacggaguauuauuuucaggaguaaguuggacaaugaaaauagguauaggaguauuauuaaccuggcuaggacuaaacucaagaagcacgagcuuaaguaugacauguauagcaguaggauuaguaacccuauauuuaggaguaaugguacaagca

SEQ ID NO: 2190 - RNA, 1983 nt, Artificial Sequence
  derived and/or modified CDS sequence (opt6) from DENV-1 CYD23__prME
uuccaucuaacuacgagaggaggagagccucacaugaucguaucaaaacaagaaaggggaaaaaguuuauuauucaaaacaucagcaggaguaaauauguguacucuaauugcaauggauuuaggagaacuaugugaagauacuaugaccuauaaaugcccaagaauaacugaagcagaaccagaugacguagauuguuggugcaacgcaacagauacauggguaacguaugguacuuguucacaaacaggagaacacagaagagauaaacguucuguagcacuagcaccacacguugguuuaggauuagaaacacgaaccgaaacuuggaugaguagugaaggagcauggaaacaaauacaaagaguagaaacaugggcguuaaggcaucccggguucacuguaauagcauuguuucuagcacaugcaauaggaacaaguauaacccaaaaaggaauaauuuucauauuauuaaugcuaguaacaccaagcauggcaaugcgaugugucggcauagguuccagagauuuuguagaaggucugaguggagcaacuuggguugauguaguucuagaacacggcucaugcguaacuacaauggcaaaagacaaaccaacauuagacauugaauuacuaaaaacagaaguuacaaauccagcuguucucagaaaauuauguauagaagcaaaaauaucuaacacuacaacugauucgagauguccuacacaaggugaagccacauuaguagaagaacaagacgcaaauuuuguauguagaagaacauuugucgacagaggauggggaaacggcugcggauuauuugguaaaggaagccuaauaacaugugcaaaauucaaaugcguaacaaaauuagaaggaaaaauuguacaguaugaaaacuuaaaauauaguguaauagugacaguacacacgggagaccaacaucaaguagguaaugaaucaacagaacauggaacaacagcuacaauuacaccacaagcaccuacuacagaaauacagcuaacugauuauggagcuuugacauuagauugcaguccaagaacggguuuagauuuuaaugagaugguauuauuaacuaugaaagaaaaaucaugguuaguacacaaacaaugguucuuagaucuaccauuaccauggacaucaggagccucaaccucacaagaaacauggaacagacaagacuuauuagucacauuuaaaacagcacaugcaaagaaacaagaagugguaguacuaggaucacaagaaggagcaaugcacacugcuuuaacaggagccacagaaauacaaacuucagguacuacuaccauauucgccggacacuuaaaaugucgguuaaaaauggauaaacuaacuuuaaaaggaaugaguuauguuaugugcacagggucauucaagcuagaaaaagaaguagcugaaacacaacauggcacaguauuaguacaaauaaaauacgaaggcacugacgcaccaugcaaaauuccauuuucuacacaagacgaaaaaggaguaacacaaaauggaagauuaaucacagcgaauccaauaguuacagauaaagaaaaaccaguaaacauagaagcagaaccgccuuuuggagaaaguuacauaguuauuggggcaggagaaaaagcacuaaaguugaguugguucaagaaaggaaguucaauaggaaaaauguuugaggcaacggcaagaggcgcucgaagaauggcgaucuuaggagauaccgccugggauuucggaaguauuggcggggucuuuacaucaguaggaaaauuaguacaucaaauauuuggaacagccuauggggucuuauuuagcggaguaaguuggaccaugaaaauaggaauuggaguauuacuaaccuggcugggauuaaauaguagaucaacaaguuugaguaugacgugcauagcuguaggucuaguaacauuauaucuaggagugaugguacaggca

SEQ ID NO: 2191 - RNA, 2025 nt, Artificial Sequence
  derived and/or modified CDS sequence (opt6) from DENV-1 CYD23__SSc-prME
ucaguaaccauguuauuaauguuaaugcccacggcauuagcauuucaucucacuacuagagguggggaaccacauaugauaguaaguaaacaggaaagaggaaaaucauuacucuuuaaaacaucagcaggaguaaauaugugcacauuaauugcaauggaucucggagaacucugugaggauacaaugacauauaaauguccacgaauaacagaagcugaaccagacgacguagauuguugguguaaugcaacagacacauggguaacauauggaacuuguucucaaacaggugaacauagaagagauaaaagaucaguagcacuagcaccacacguaggucuaggauuagaaacaaggacagaaacauggaugucuucugaaggggcuuggaaacaaauacaaagaguugaaacgugggcauuaagacacccuggauucacaguaaucgcauuauuuuuagcacacgccauaggaaccucuaucacccaaaaaggaauaauuuucauauuacuaaugcuaguaaccccaucaauggcuaugcgaugcguaggaaucgguaguagagauuuuguugaaggacuaagcggagcgacauggguagaugucguacuagaacauggaucauguguuacaacaauggcaaaagauaaaccaacacuagauauagaauuauuaaaaacagaagugacaaacccagcuguacuaagaaaacuaugcauagaggccaaaauaaguaauacaacgacagacaguagauguccaacacaaggcgaagcaacccuuguagaagaacaagaugcaaacuucguaugcagaagaacauuuguagacagagguuggggaaauggauguggacucuuuggaaaaggaucauuaaucacaugcgcaaaauuuaaauguguaacaaaauuagaaggaaaaauaguacaauaugaaaacuuaaaauauucgguaaucguuaccguacacacuggagaucaacaucaaguagggaaugaaucaacagaacauggcacuacagcaacaauaacaccacaagcaccaacaacagaaauucaauuaacagauuacggagcacuaacuuuagacugcucaccuagaacggguuuagauuuuaacgaaaugguuuuauuaacuaugaaagaaaaaucaugguuaguucacaaacaaugguuucuagaucuaccauuaccauggaccagcggagcaucaacaucacaggaaacauggaacagacaagaucuuuuaguaaccuucaaaacugcacacgcaaagaaacaagaaguagucguacuaggcucucaagaaggugcaaugcauacggcauuaacaggcgcuacagaaauacagacgucugggacaacaacaauauucgcaggacaccuaaaaugcagauuaaaaauggauaaacugacuuuaaaaggaaugaguuauguaauguguacagggucauuuaaacuagagaaagaagucgcagaaacacaacacggaacagugcuagugcaaauaaaauaugaaggaacagaugcaccuuguaaaauacccuuuagcacacaagaugaaaaagguguaacccaaaauggaagauuaauaacagcuaauccaauaguuacugauaaagaaaaaccaguuaacauagaagcagaaccaccauuuggggaaucauacauaguaaucggagcaggggaaaaagcauuaaaacuaagcugguuuaagaaaggaagcucgauagguaaaauguuugaagcaacagcaagaggagcaagaagaauggcaauuuugggagacacagcaugggacuuuggcaguauuggaggaguauucacuucaguaggaaaauuaguccaccaaauauuuggaacugcauacggaguucuuuuuagcggaguaucauggaccaugaaaauaggaauaggaguacuucuaacaugguuaggacuuaauagcaggaguacaaguuuaaguaugacauguauagcaguuggucuaguuacccuguacuuagguguaaugguacaagca

SEQ ID NO: 2192 - RNA, 2325 nt, Artificial Sequence
  derived and/or modified CDS sequence (opt6) from DENV-1 CYD23__C-prME
augaauaaucaaaggaagaaaaccgcgaggccaaguuucaauaugcuuaaaagagcaagaaauagagugaguacagucucacaauuagcuaaacgauuuagcaaagguuuauuauccggacaaggaccaaugaaauuaguuauggccuucauagccuuucuaagguucuuagccauaccaccuacagcgggaauacuagcaagauggggaaguuucaagaaaaauggugcaauaaaaguuuuaagaggauuuaagaaagaaauauccaauaugcuaaauauuaugaauagacgaagaaaaagugugacuauguuacuaauguuaaugccaacagcucuugcuuuccaucuuacaacaagagggggagaaccacacaugauaguauccaaacaagaaagaggaaaaucacugcucuuuaaaacaagugcaggaguaaauauguguacauuaauagcaauggacuuaggggaacuaugcgaagauacaaugacauacaaaugcccaagaaucacagaagcagaaccugacgauguagacugcugguguaacgcaacagauaccuggguaaccuacgguacaugcagucaaacgggagagcaucgaagagauaaaagaaguguugcauuagcaccccacguggguuuaggguuagaaacaagaacagaaacauggaugagcagcgaaggugccuggaaacaaauacaaagaguagaaacuugggcauuaaggcaucccggcuuuacagucauagcacuauucuuagcacaugcuauaggaacuagcauaacacaaaaaggaauaauauucauauuacucauguuaguuacaccguccauggcuaugagaugcguaggaauaggaagcagagacuuuguugaaggucuaaguggagcaacguggguugauguuguauuggaacaugggagcugugucacaacaauggcuaaagauaaaccuacauuagauauagaauuacuaaaaacagaggucacaaauccugcagugcuuaggaaauuauguauagaagcaaaaauaagcaauacaacaaccgauucaagaugcccuacccagggagaagccacucuaguagaagaacaagacgcaaauuuuguauguagaagaacuuucguagacagggguuggggcaacggaugcggcuuauuuggaaaagggucuuuaauaacgugugcaaaauuuaaaugugucacaaaauuagaagggaaaauaguucaguaugaaaauuuaaaauacagcgucauaguaacaguacacacuggugaucaacaucaaguagggaaugagaguacagaacacggaacaacagcaacaauaacgccacaagcuccaacaaccgaaauucagcuaacagauuauggggcauuaacucuugacuguucaccucgaacuggcuuagauuuuaacgaaaugguucuauuaacaaugaaagaaaaaucguggcuaguacauaaacaaugguuccuugacuuaccauuaccauggacaaguggugcaucuaccucacaagaaacauggaauaggcaagauuuauuaguaacauuuaaaacagcacaugcaaagaaacaagaaguuguuguuuuaggcucacaagaaggcgcaaugcauacagcauuaacuggagcaacagaaauacaaacaucaggaaccacaacuauauuugcaggacaccucaaauguagauugaaaauggauaaauuaacauuaaaaggaaugucauacgugaugugcacaggaucauuuaaacucgaaaaagaagucgcagaaacacaacacgggacaguuuuaguacaaauaaaauacgaaggaacagaugcgccuuguaaaauaccauucucaacacaagaugaaaaaggagucacucaaaauggaagauuaaucacggcaaacccaauaguaacagauaaagaaaaacccgugaauauagaggcugaaccaccauuuggugaaagcuauauagugauaggagccggugagaaagcacuaaaauuaagcugguuuaagaaaggaaguaguauaggaaaaauguuugaagcgacagcacgaggagcaaggagaauggccauauuaggagauacagcaugggauuuuggcaguauugggggaguauuuacaaguguagguaaauuaguacaucaaauuuuuggaacagcauacggaguacuauucucgggaguuucguggacaaugaaaauaggaauaggaguacucuuaacaugguuaggacuaaauucaagaucuacaucauuaagcaugacuuguauagcgguaggauuaguuacccuuuaccucggagucaugguacaagca

SEQ ID NO: 2193 - RNA, 45 nt, Artificial Sequence
  derived and/or modified CDS sequence (opt6) from DENV-1 CYD23__SSc
augucaguaacaauguuauuaauguuaaugccaaccgcacucgca

SEQ ID NO: 2194 - RNA, 57 nt, Artificial Sequence
  derived and/or modified CDS sequence (opt6) from DENV-1 CYD23__SSopt
augaaaagaaaaaaaucaguaacaaugcuacuaaugcuaaugccaacagcacuagca

SEQ ID NO: 2195 - RNA, 57 nt, Artificial Sequence
  derived and/or modified CDS sequence (opt6) from DENV-1 CYD23__SSm
augacacaaaaaggaauaauauucauacuacuaaugcuaguaacaccaucaauggca

SEQ ID NO: 2196 - RNA, 1488 nt, Artificial Sequence
  derived and/or modified CDS sequence (opt6) from DENV-1 CYD23__E
augagaugcgucgggauagguucacgggauuucguagaaggauuaucaggagcaacauggguagacguaguauuagagcaugguucauguguaacuacaauggcuaaagauaaaccaaccuuagauauagaacuauuaaaaacagaaguaacaaacccagcaguauuaagaaaauuaugcauugaagcaaaaauaaguaacacaacaacagauaguagaugucccacucaaggagaggcaacacuaguagaagaacaagaugcaaauuucguaugccgacgcacuuuuguagauagaggauggggaaauggaugcggauuauucggaaaaggaucacuaauaacaugugcaaaguuuaaaugcguaacaaaacuagaaggaaaaauaguacaauacgaaaaucuaaaauauuccguaauaguaacaguucauacaggcgaccaacaucaaguaggaaaugaaucaacagaacaugggacaacagcaacaauaaccccgcaagcuccaacgacagaaauacaauuaacagauuacggcgcacuaacucuagacuguaguccaagaacaggauuagauuuuaacgaaaugguauuacuaacaaugaaagaaaaaucaugguuaguccacaaacaaugguuucuagaucucccauuaccauggacauccggagccagcacuucacaagaaaccuggaauagacaagaccuacuaguaacauuuaaaacagcacaugcaaaaaaacaagagguaguaguacugggaucacaagaaggagcgaugcauacagcguuaacaggagcaacagaaauucaaacaucaggaacaacaacaauauucgcaggacauuuaaaaugcagauuaaaaauggauaaauuaacguuaaaaggaaugucauacguuauguguacaggaaguuuuaaacuugaaaaagaaguugcagaaacacaacacggaacgguacuuguucaaauaaaauaugaaggcaccgaugcaccaugcaaaauaccauucaguacacaagaugaaaaaggaguaacacaaaauggaagauuaauaacggcaaaucccauagucacagacaaagaaaaaccaguaaacauagaagcagaaccaccguuuggugaaaguuauaucguaauaggugcaggagaaaaagcauuaaaauuaucaugguuuaaaaaaggauccagcauagguaaaauguucgaagcuacagcaagaggagcaagaagaauggcgauacuaggagauaccgcaugggauuuuggaucaauaggaggaguuuucaccucaguaggaaaauuaguacaucagauauucggaacagcauacgguguuuuauucuccggagucaguuggacaaugaaaauuggaauaggaguacuauuaacaugguuaggucuaaauaguagaaguacaucacuaaguaugacauguauagcagucggauuaguaacacuauaucuaggagugaugguacaagcauaa

SEQ ID NO: 2197 - RNA, 1182 nt, Artificial Sequence
  derived and/or modified CDS sequence (opt6) from DENV-1 CYD23__EdelTM-variant (aa1-394)
augagaugcguaggaaucgggucaagagacuuuguagaaggauuaucaggagcaacauggguagacguaguacucgaacacggcucaugcguaacaacaauggcaaaagacaaaccaacacuagacauagaauuauuaaaaacagaagucacaaacccagcaguauuaagaaaacuaugcauagaagcaaaaauaucaaauacaaccacagacucaagaugcccaacacagggagaagcaacacucguagaagaacaagaugccaauuuuguaugcaggagaacauuuguagauagaggauggggcaacggaugcggauuauucggaaaaggaucauuaauuacaugugcaaaauucaaaugcguuacaaaacuagaagguaaaaucguacaauaugaaaaccuaaaauauucaguaauaguaacuguccauacaggagaucaacaccaaguagguaaugaaucaaccgaacauggaaccacagcaacaauaacaccacaagcaccaacaaccgaaauacaacuaaccgacuacggagcauuaacauuagacugcucaccaagaaccggauuagacuucaacgaaaugguacuacuaacaaugaaagaaaaaucauggcuaguacacaaacaaugguuuuuagaccuaccacuaccauggacaucaggugcaaguacaucacaagaaacauggaaucgacaagacuuacuaguaacauucaaaacagcacacgcaaaaaaacaagaagucguaguacuaggaucacaagaaggagcaaugcauaccgcauuaacaggagccaccgaaauacaaacaagcggaacaacaacaauuuucgcaggacaccuaaaaugcagguuaaaaauggacaaauuaacacuaaaaggaaugucauacguaaugugcacaggaucauucaaacuagaaaaagaaguagcagaaacacaacauggaacaguacuaguacaaauaaaauacgaaggaacagaugcaccaugcaaaauaccauucaguacacaagacgaaaaaggaguaacacaaaauggcagguuaauaacagcaaacccuauaguaacagacaaagaaaaaccaguaaacauagaagcagaaccaccauucggagaaaguuauauaguaaucggagccggugaaaaagcucuaaaauuauccugguucaaaaaa

SEQ ID NO: 2198 - RNA, 1275 nt, Artificial Sequence
  derived and/or modified CDS sequence (opt6) from DENV-1 CYD23__EdelTM-variant (aa1-424)
augagguguguuggaauaggcagcagagauuucguagaaggcuuaagcggugcaacauggguagacgugguacuagaacacgguucaugcguaacgacaauggcaaaagauaaaccaacacuggacauagaauuacuaaaaacugaaguaacaaauccagcaguauuaagaaaauuaugcauagaagcaaaaaucagcaacacaacaacagauaguagaugcccaacucaaggagaagccacacucguagaagaacaagaugcaaauuucgucuguaggagaacauuuguagauagaggauggggaaauggauguggacuauucggaaaaggcagcuuaauaacaugcgcaaaauuuaaaugcguaacaaaauuggaaggaaaaauaguacaauacgaaaacuuaaaauauucaguaauaguaacaguucacacgggagaucaacaucaaguaggaaaugaaucaacagaacauggaacaacagcaacgauaacgccacaagcaccaacaacagaaauacaauugaccgauuacggagcauuaacauuagacuguagcccacgaacaggauuagacuuuaacgaaaugguacuauuaacaaugaaagagaaaagcuggcuuguacauaaacaaugguuuuuagaucuaccacuaccauggacaaguggagcaucaacuucacaagaaacauggaacagacaagacuuauuaguaacuuucaaaacugcacaugcgaagaaacaagaaguaguaguacuaggaucacaagaaggagcaaugcauacagcacucacaggagcuacagaaauacaaacaucagguacaacaacgaucuuugcgggacaccuaaaaugcagacuaaaaauggacaaacuaacacuaaaagguaugagcuauguaaugugcacggguucauucaaacuagaaaaagaagucgcagaaacacaacauggaacagucuuaguacaaauaaaauacgaagguacagacgcaccaugcaaaauaccauuuaguacacaagacgaaaaaggaguaacacaaaauggaagacuaauaacagccaauccaauagucacugacaaagaaaaaccaguaaacauagaagcggaaccacccuuuggcgaaagcuauauaguuauaggagcaggggaaaaagcacuuaaauuaucaugguuuaagaaaggaagcucaauaggaaaaauguuugaagccacagccagaggagcaagaagaauggcaauccuaggagauacagcaugggauuucggaucuuaa

SEQ ID NO: 2199 - RNA, 1266 nt, Artificial Sequence
  derived and/or modified CDS sequence (opt6) from DENV-1 CYD23__EdelTM-variant (aa1-421)
augcgauguguaggaauaggaucaagagacuucguagaaggacuaaguggagccacauggguggacguaguacuagaacauggaaguuguguaacaacaauggcaaaagauaaaccaacauuggacauagaauuauuaaaaacagaaguaacaaacccagcaguacuaagaaaacuaugcauagaagcaaaaauaaguaauacuacaaccgauucaagguguccgacacagggagaagcaacacugguagaagaacaagaugcuaauuuuguauguagaagaacauuuguagacagaggauggggcaacggaugcggauuauuuggaaaaggaagucuaaucacaugugcaaaauuuaaauguguaacaaaauuagaaggaaaaauaguacaauaugaaaauuuaaaauauagugugauaguaacaguacacacgggcgaucaacaucaaguaggaaaugaaaguacagaacauggaacaacagcaacaauaacgccacaagcaccaacaacagaaauacaacuaacagauuauggagcacuaacauuagacuguaguccacgaacaggacuagacuuuaacgaaaugguacuuuugacaaugaaagagaaaaguugguuaguucacaagcaaugguuuuuagauuuaccauuaccauggacaagcggagcgucaacaucacaagaaacauggaacagacaagaucuauuaguuacauucaaaacagcacaugcaaagaaacaagaaguaguaguacuagggagucaagaaggagcaaugcauaccgcucuaacaggagcaacagaaauacaaacaucgggaacaacaacaauauuugcaggacaccugaaaugccgacucaaaauggacaaauuaacacuaaaaggaaugaguuauguaauguguacaggaucauucaaacuagaaaaagaaguagcagaaacacaacacggaacaguccuaguacaaauaaaauaugaaggaacggacgcacccuguaaaauaccauucaguacacaagaugaaaaagguguaacacaaaacggaagauugauaacagcaaauccuauaguuacagacaaagaaaaaccaguaaauauagaagcagaaccaccauucggagaaaguuauauuguaaucggagccggagaaaaagcauuaaaacuaagcugguucaagaaagguaguaguauaggaaaaauguuugaagcuacugcaagaggagcuagaagaauggcaauauuaggagauacagcuugggauuaa

SEQ ID NO: 2200 - RNA, 2031 nt, Artificial Sequence
  derived and/or modified CDS sequence (opt6) from DENV-1 CYD23__SSc-prME
augucaguaacaaugcuauugaugcucaugccuacugcuuuagcauuucaucuuacaacgcgaggaggagaaccgcacaugauaguaucaaaacaagaaagaggcaaaucauugcuauucaaaacaagcgcaggcguaaacauguguacauuaauagcuauggacuuaggggaguuaugcgaagauacaaugacauacaaauguccaagaauaacagaagcagaaccggacgacguagacuguuggugcaacgcaacagauacauggguaacauaugguaccuguucucaaacaggcgaacauagaagagauaaaagaagcguagcacuagccccacacguuggucuaggauuagaaacuaggacagaaacauggauguccucagaaggagcauggaaacaaauacagagaguagaaacaugggcauuaagacacccaggauuuaccguaaucgcauuguuuuuggcacaugcaauaggaacaucaauaacacaaaaaggaauaauauuuauacuauuaauguuaguaacacccaguauggcaaugagauguguaggcauugguaguagagauuuuguagaaggucuaucaggagcaacuuggguagaugugguauuagaacauggcaguuguguaacuacaauggcuaaagauaaaccaacauuagauaucgaauuauuaaaaacugaaguaacuaauccugcaguacuaaggaaauuaugcauagaagcaaaaauaaguaacacuacaacagauaguagaugcccgacucaaggggaagcaacucuaguagaagaacaagaugccaauuuuguuuguaggagaacauucguagauagaggaugggguaauggcugugguuuauuuggaaaagguucauuaauaacuugcgcaaaauuuaaaugcguaacgaaacuagaaggaaaaauagugcaauaugaaaaccuaaaauauucaguaauaguuacaguacauacuggugaucaacaucaaguaggaaaugaaucaaccgagcauggaacaacugcaacgauaacuccccaagcaccaacaacagaaauccaauuaaccgacuauggagccuuaacuuuagauuguagcccacgaacaggacuagauuuuaaugagaugguauuacuaacuaugaaagagaaaaguuggcuaguucauaaacaaugguuuuuagauuuaccacuaccuuggacaaguggugcauccacaagucaagaaacuuggaauagacaagaucuauuagugaccuucaaaacagcccacgccaagaaacaagaaguaguagucuuagguagucaagaaggagcuaugcauacagcauuaacaggugccacugaaauacaaacaucagguacuacuacaauuuucgcaggacauuuaaaauguagacuaaaaauggacaaacuaacacuaaaagguaugaguuauguaaugugcacaggaucauuuaaauuagagaaagaaguagcagaaacacaacauggaacaguauuaguucaaauaaaauacgaaggaacagaugcaccauguaaaauaccauuuagcacgcaagaugaaaaaggaguaacccagaauggaagacuaauaacggcuaacccaaucguaacagacaaagaaaaacccgugaauauagaagcagaaccaccauuuggagaaaguuacauagugauuggagccggagaaaaagcguuaaaauuaaguugguucaagaaaggaucaaguauaggaaaaauguuugaagcuacggcaagaggagcaagacgaauggcaauauuaggagauacagccugggauuuuggaaguauaggagguguauuuaccagcguaggaaaauuaguacaucaaaucuucggaacugcauauggaguacucuucaguggagucucuuggaccaugaaaauagguauuggaguguuauuaacauggcuaggguuaaacaguagaucaacuucacuaucaaugacaugcauagcugugggucuaguaacuuuauacuuagguguaaugguacaagcauaa

SEQ ID NO: 2201 - RNA, 2031 nt, Artificial Sequence
  derived and/or modified CDS sequence (opt6) from DENV-1 CYD23__SSc-prME(F108S)
augagugucacaaugcuauuaaugcuaaugccaacggcacuggcauuucauuuaacaacaaggggaggagagccacauaugaucguuucuaaacaagaaagaggaaaaucacuguuauuuaaaacaucagccgguguuaacaugugcacacuaauagcaauggacuuaggagaacuaugugaggacacaaugacuuacaaauguccaagaauaacagaagcagagccagaugauguagauuguugguguaacgcuacggauacauggguaacuuauggaacuuguucacaaacaggugaacacagacgagauaaaagaaguguagcacuugcaccucaugucggacuagguuuagaaacaagaacagaaacauggaugucaucugaaggagcauggaaacaaauucaacgaguagaaacaugggcauuaaggcacccuggauuuacagucauagcauuauuccuagcucaugcaauaggaacaagcauaacacaaaaaggaauaauauucauauuauuaaugcuaguaacaccaucaauggcaaugagauguguagguauaggaaguagagauuuuguugaaggacuaagcggagccacauggguagacgugguacuagaacauggaucauguguaacaacuauggccaaagauaaaccaacacuagauauagaauuacuaaaaacagaaguaaccaauccagcgguacuuagaaaacuguguauagaagcaaaaauaucuaauacaacaacagacucaagaugcccaacacaaggagaagcuacgcuaguggaagaacaagaugcuaauuucguguguagaagaacauucguagacagaggauggggaaacggcuguggucugagcggaaaaggaucuuuaauaacuugcgcaaaauuuaaaugugucacaaaauuagaaggaaaaauaguccaguaugaaaaucuaaaauauucaguaauaguuacagugcacacaggugaccaacaucaaguaggaaaugaaucaaccgagcauggaacaacagccacaauaacaccacaagcccccacaacagaaauacaacuaacugacuacggagcauuaacacuggauuguucaccacgaacaggauuagauuucaacgaaaugguacuacuaacuaugaaggaaaaaucuuggcuaguacauaaacaaugguuucuagaucuuccacuuccauggacauccggcgcuaguacaucacaagaaacauggaauagacaagaccuauuagucacauuuaaaacagcacaugcgaagaaacaagaaguaguaguacuagguucgcaagagggagcaaugcacacagcacucacgggagcaacagaaauacaaacaucaggaacaacaacaauauuugcgggacauuuaaaauguagauugaaaauggauaaauuaacccuaaaagguaugaguuauguuauguguacaggaaguuuuaaauuagagaaagaagucgcagaaacacaacaugguaccguuuugguucaaauaaaauaugaaggaaccgaugcuccuuguaaaauuccauucaguacgcaagaugaaaaaggaguaacacaaaacggcagauuaauaacagccaacccaauaguaacugauaaagaaaaacccguaaauauagaagcagaaccaccauuuggugaaucauacauaguaaucggagcgggggaaaaagcacuaaaauuaaguugguuuaagaaaggcaguucgauagggaaaauguucgaagcaacugcaagaggagcacgaagaauggcaauacuuggagauacugcgugggacuuuggaaguauaggagguguauuuaccaguguaggcaaauuaguacaccaaauauuugggacagcguauggaguauuauuuucuggaguaucuuggacaaugaaaaucgguauaggaguuuuacuaacuugguuagggcuaaacucaagaaguacaaguuuaucaaugacuugcauagcaguaggacuuguaacacuuuacuuaggagucaugguacaagcauaa

SEQ ID NO: 2202 - RNA, 2031 nt, Artificial Sequence
  derived and/or modified CDS sequence (opt6) from DENV-1 CYD23__SSc-prMEdelstem_TM-JEV
augaguguaacaauguuauuaaugcucaugcccacagcuuuagcauuucaucuaacaaccagggguggagaaccccauaugauaguauccaaacaagaaagaggaaaaagucucuuauuuaaaacaagugccggcgugaacauguguacacuaauagcaauggauuuaggagaacuaugugaagauaccaugacauacaaaugcccacguauaacagaagcagaaccagacgaugucgacuguuggugcaaugcaacagauacauggguaacauauggcacauguucgcaaacuggugaacacagaagagauaaaagaaguguagccuuagcaccacaugucggucugggauuagagacacgaacugaaacuuggaugaguucagaaggagcauggaaacaaauacaaagagucgaaacuugggcauuaagacauccaggauucaccguuauagcuuuauucuuagcacaugcaauaggaacaucaauaacacaaaaggguauaauuuuuauauuauuaauguugguaacaccaucaauggcaaugagaugugugggaauagguucacgagauuuuguugaaggcuuaucaggagccacauggguagauguuguguuagaacauggaaguuguguaaccacgauggccaaagacaaaccaacgcuagauauagaauuacuaaaaacugaaguaacaaauccagcaguacucagaaaacucuguaucgaagcaaaaauaaguaacacuacuacagacagccgauguccaacacaaggugaagccacauuaguagaagaacaagaugcaaauuuuguauguagaagaacauucguggauagaggauggggaaauggcuguggauuauuuggaaaaggaucuuuaauaacaugugccaaauuuaaaugcguaacaaaauuagaaggaaaaaucguccaauaugaaaaucucaaauauucaguaauaguuaccguacauacaggagaucaacaccaagucggcaaugaaucaacagagcacggaaccacagcaacaauuacuccacaagcaccuacaacagaaauacaacuaaccgacuauggagcauugacauuagauuguaguccaagaacaggacuagacuuuaaugaaaugguacuauuaacuaugaaagagaaaaguuggcuaguccauaaacaaugguuucuagaucuaccacuaccauggacaaguggagcaaguacuucacaagaaaccuggaauagacaggauuuauuagugaccuucaaaacagcacaugcaaagaaacaagaaguaguaguucuagguucacaagaaggagcaaugcacacggcuuuaacaggagcaacugaaauacaaacaaguggaacaacaacaauuuuugccggacaucuaaaaugcagauuaaaaauggauaaacuaacacuaaaaggaaugaguuacguaauguguacaggcuccuuuaaacuagaaaaagaaguugccgaaacucaacauggaacaguuuuaguacaaauaaaauacgaggguacugaugccccaugcaaaauaccauuuucaacacaagaugaaaaaggaguaacacaaaacggcagacuaauaacagcgaauccaauaguaacggauaaagaaaaaccuguaaauauagaagccgaaccuccuuucggagaauccuacauuguaauaggagcaggagaaaaagcccucaaauuaaguugguuuaaaaagggauccacauuaggaaaggcuuuuucuacaacauuaaaaggugcacaacgacuagcagcucuaggugauacagcaugggauuucggaucaauaggaggaguauucaacucuauaggacgagcaguccaccaaguauuugguggugcauucagaacacuuuuuggaggaaugucauggauaacacaaggacuaaugggagcuuuacuacuuuggaugggugucaacgcaagagacagaagcauagcuuuagcauuuuuggcaacuggaggaguauuaguauuccuggcuacaaauguacaugcauaa

SEQ ID NO: 2203 - RNA, 2379 nt, Artificial Sequence
  derived and/or modified CDS sequence (opt6) from DENV-1 CYD23__C-P2A-SSc-prME
augaauaaccaaagaaaaaaaacggcaagaccaaguuuuaauaugcuaaagcgagcaagaaaucgaguaucaacgguuucucaacuugcaaaaagauucucaaaaggcuuacuaaguggacagggaccuaugaaauuaguuauggcauuuauugcauuuuuaagauucuuagcuauaccaccaacagcaggaauauuagcuagauggggaucuuuuaaaaaaaauggagcaauaaaaguauuaagaggauuuaaaaaagagauaucaaauauguuaaacauaaugaaccguaggagaaaaaacuucgauuuacucaaacuagcaggggauguagaaucaaauccaggccccucgguuaccauguuauuaaugcugaugcccacugcacuagcauuucaucuuacaacaagaggaggagaaccacauaugauagucucgaaacaagaaagaggaaaaucuuuacuuuucaaaacaagugccgguguaaacauguguacauuaauugccauggaucuaggggaacugugugaagacacaaugacauauaaaugccccagaauaacagaagcagaacccgaugauguugauuguugguguaaugcgacugauacauggguaacguacgguacauguucacaaacuggcgaacauagacgagauaaacgaagcguagcgcuugcaccucacguugguuugggccuugaaacccgcacagagacuuggaugucuagugaaggcgcguggaaacaaauccaaagagucgaaacaugggcacuaagacauccaggauucacaguaauagcucuauuucuagcccaugcaaucggaacuucaaucacgcaaaaaggcauaaucuuuauauuacuaaugcuagucacaccaucaauggcaaugagguguguaggaauaggaucuagagauuuugucgaaggauuauccggagcuacauggguagauguaguguuagagcacgguaguugcguuacuaccauggcaaaagauaaaccuacucuagauauugaacuacuaaaaacagaaguaacaaacccagcuguauuaagaaaauuaugcauagaagcaaaaauaagcaauacaacaacagauaguagauguccaacacaaggugaagcuacacucgucgaagaacaggacgcaaauuuuguauguagaagaacauuuguagauagaggauggggaaauggauguggacuauuuggaaaagguucacuauugacaugugcuaaauucaaaugugucacuaaauuagaaggaaaaauaguacaauacgaaaaucuaaaauauucaguaauaguaacaguucauacgggagaccaacaccaaguaggaaaugaaucuacagaacauggaacuacagcaacaauaacaccccaagcaccaacaacggagauucaacuuacagauuauggagcgcuaaccuuagauuguuccccccgaacaggauuagauuuuaaugaaaugguccuauugaccaugaaagaaaaauccuggcugguacauaaacaaugguuucuugacuuaccauuaccauggacauccggagcaaguacaucacaagaaacauggaacaggcaagaccuauuagucaccuuuaaaacagcacacgcaaaaaaacaagaaguaguaguucuaggaucacaagaaggagccaugcauacagcacuuacaggagcaacagaaauacaaacaagugguacaacuaccaucuuugcagggcaucuaaaaugcagauuaaaaauggacaaacuaacucuaaaaggaaugucuuacgugauguguacggguucuuuuaaauuagagaaagagguagccgaaacacaacacggaacaguacuuguacaaauaaaauaugaaggaacagaugcgccauguaaaauaccauucucaacacaagacgaaaaaggggucacacaaaauggcagauugauuacagccaauccaauaguuacagauaaagaaaaaccuguaaauaucgaagcagaaccgccauucggagaguccuacauuguuauaggcgcaggagaaaaagcauuaaaacuaucaugguuuaaaaaaggaucaagcauagguaaaauguucgaagcgacagcacgaggagcaagaagaauggcuauacuaggagauacagcuugggauuuuggaucaauaggaggcgucuucacaucaguagguaaacuaguacaucaaauauuugguacagcauauggaguauuauucucaggaguuucauggacuaugaaaauaggaauaggcguacuauuaacuugguuaggauuaaauuccagaaguacaucauugucuaugacuugcauugcuguaggacuaguaacuuuguaucuaggaguaaugguacaagcauag

SEQ ID NO: 2204 - RNA, 2043 nt, Artificial Sequence
  derived and/or modified CDS sequence (opt6) from DENV-1 CYD23__SSopt-prME(F108S)
augaaacgaaagaaauccgucacaaugcuucugauguuaaugccaacagcccuagcauuccacuuaaccacaagaggaggagaaccacauaugauaguaagcaaacaagaaagggguaaaaguuuauuauucaaaacaagugcuggaguaaacaugugcacacuaauagcaauggauuugggggaauuaugugaagauacaaugacauacaaauguccacguauaacagaagcugaaccugaugacguagauuguuggugcaaugcuacggauacauggguaacauauggaacuugcucacaaacaggagaacauagaagagacaaaagaagcguagcacuagcaccgcauguuggacuaggcuuagaaacaagaaccgaaacauggaugagcagugaaggugcauggaaacaaauccaaagaguagaaacaugggcacuucgacacccagguuucacuguaauagcuuuauucuuagcacacgcaauugguacguccauuacucaaaaaggcauaauauucauacuauuaaugcuugucaccccaucaauggcaaugcgauguguugggauaggcagccgagacuuuguagaaggauuaaguggggcaacgugggucgauguuguuuuagaacacggaucauguguaaccaccauggcaaaagacaaacccacacuagauaucgaauuauuaaaaacagaaguaacuaauccugcaguauuaagaaaacuuuguauagaagcuaaaauaaguaauacaacuaccgauucaaggugcccgacccaaggagaagcaaccuuaguugaagaacaagaugcaaacuucguauguagacgaacauuuguugauagaggauggggcaacggauguggacuaaguggaaaaggaucacuaaucacaugcgcaaaauuuaaauguguuacaaaacuagaaggaaaaauaguccaauacgaaaauuuaaaauacaguguaauaguuacaguacacacuggagaccaacaucaaguaggcaacgaaucaaccgaacacggaacaaccgcuacaauuaccccacaagcaccaacaacagagauucaauugacagauuacggagcacuuacauuagacuguucaccaagaacaggauuagauuuuaaugaaaugguacuauuaacaaugaaagagaaaaguugguuaguacauaaacaaugguuuuuagaucuacccuuaccauggacaaguggagccucaacuucucaagaaacuuggaauagacaagaucuauuagucacauuuaaaacagcacaugccaagaaacaagaagucguaguauuaggaucacaggaaggcgcuaugcauacagcauuaacaggagcaaccgaaauacaaacaucagguacaacuacaaucuuugcaggacacuuaaaaugcagauuaaaaauggacaaacuaacauuaaaaggaaugucauaugugauguguacuggaaguuuuaaacuagaaaaagaaguagcagaaacgcaacacggaacagucuuaguacaaauuaaauaugaaggaacagacgcaccauguaaaaucccauucaguacucaggacgaaaaagggguuacacaaaauggaagacuaauaacagcaaaucccauuguaacugacaaagaaaaaccaguaaauauugaagcugaacccccauuuggugaaucauacauaguaauaggcgcaggagaaaaagcacuaaaauuauccugguuuaagaaaggaucaucaauaggaaaaauguuugaagcaacugcaagaggagcaagaagaauggcaauacuaggggacacagcaugggacuuuggaucaaucggaggcguauuuacaucuguagguaaauuaguucaucaaauuuuuggaacugccuauggcguauuauuuucaggcguaucauggaccaugaaaauaggaaucggaguuuuacuaacaugguuaggauuaaauucccgaagcacgucacuuagcaugacauguaucgcagugggccuagucacauuauauuuaggagugaugguacaagcauaa

SEQ ID NO: 2205 - RNA, 2043 nt, Artificial Sequence
  derived and/or modified CDS sequence (opt6) from DENV-1 CYD23__SSopt-prME(F96H)
augaagaggaaaaaaucggucacgauguuauuaauguuaaugccaacagcacuugcuuuucaucuaacuacacgcggcggugagccccauaugauaguaaguaaacaagaaagagguaaaagucuacuauuuaaaacaucugcaggagugaacauguguacauuaauagcaauggauuuaggugagcuaugcgaagacaccaugaccuacaaauguccaagaauuacagaagcugaaccagaugauguugauugcuggugcaacgccacagacacauggguaacauauggaacaugcucacaaacaggagaacauagacgagauaaaagaucaguagcauuagcaccacauguaggacugggacucgaaacgagaacagaaaccuggaugagcagugaaggagcauggaaacaaauacaaaggguagagacaugggcacuaagacacccaggauuuacaguaauagcacuauuccuugcucacgcaauaggaacauccauaacucaaaaaggaauaauauuuauauuauuaauguuagucacuccgaguauggcaaugagaugcguaggaauaggaaguagagauuuuguagaaggcuuaucaggcgcaacauggguagauguaguauuagaacauggaucuuguguaaccacgauggcaaaagauaaaccaacuuuagacauagaacuacuuaaaacagaaguaacaaacccagccguacuaagaaaacuauguauagaagcaaaaauaagcaauacaacuaccgacucaagaugcccaacucaaggagaagccacacucguggaagaacaagacgcaaacuuuguaugcagaagaacacauguagauaggggauggggaaacggauguggacuauucggaaaaggaucccuaauaacaugugcaaaauucaaaugugucacaaaauuagaaggaaaaauaguacaauacgaaaacuugaaauacagcguaauaguaacaguacauacaggagaucaacaucaaguaggaaaugaaucaacugaacauggaacaacagccacaauaacaccacaagcaccaacaacagaaauacaacuaacagauuauggagccuuaacacuagacuguucaccgagaacaggcuuagacuuuaaugaaauggucuuacuaacaaugaaagaaaaaagcugguugguacacaaacagugguuccuagaccuaccccuaccauggaccucaggagccucuaccucacaagaaaccuggaaccgacaagauuuacugguaacauuuaaaaccgcacaugcaaaaaaacaagaagucgucguauuaggcagucaagaaggagcaaugcauacagcacucaccggugcaacagaaauucaaacaucagguacaacaacuauauuugcaggacauuuaaaaugccguuuaaaaauggacaaauugacccuaaaaggaaugaguuacgucauguguacgggaaguuuuaaacuagaaaaagaaguagccgagacccaacacggaacaguuuuaguacaaauuaaauaugaaggaacagacgcuccaugcaaaauaccauucagcacccaagaugaaaaagguguaacacaaaaugggcgauuaauuacagcaaauccuauaguuacggacaaagaaaaaccugugaauauagaagcugaaccacccuuuggggaauccuauauaguaauaggagcaggugaaaaagcacuaaaauuaaguugguucaagaaaggaucaaguauaggcaaaauguuugaagcaacagcaagaggagcaagacgaauggcgauacugggagauacugcaugggauuuuggaaguauaggaggaguauuuacuaguguagggaaauuaguacaccaaauauucggaacugcauaugguguauuauuuucagggguauccuggacuaugaaaaucggaauaggcguucuuuuaacauggcuaggucuaaauucaagaagcacauccuugucaaugacuugcauugcaguagggcuaguaacucuauacuuaggaguaauggugcaagcauag

SEQ ID NO: 2206 - RNA, 2043 nt, Artificial Sequence
  derived and/or modified CDS sequence (opt6) from DENV-1 CYD23__SSopt-prME(S186F)
augaaacgaaagaaaucgguaacaaugcuauuaaugcuaaugccaacagcacuagccuuucaccuaacaacaagaggaggagaaccccauaugauaguaucaaaacaagaaagaggaaaaucauuauuauuuaaaacaagugccggagugaauaugugcacacuaauagcgauggaccuaggagaacuaugugaagauaccaugacauauaaaugcccaagaauaacugaagcagaaccggaugauguagauugcuggugcaaugcaacagacacauggguaacauauggaacauguucacagacuggagaacauaggagagauaaacgaucaguagcauuagcaccacacguaggccuaggacuagaaacaagaacagaaacauggaugucaucagaaggggcauggaaacaaauacaacgcguagaaacaugggcauuacgacauccaggauucacuguuauagcucuauuucuagcucaugcaauaggaacaucaauuacacaaaaagguauaauauuuauauuauugaugcuaguaacaccuaguauggcuaugagauguguugguauaggaagcagagacuucguugaaggauuauccggcgcaacauggguagauguaguauuggaacauggcagcugcguaacaacuauggcaaaagacaaaccaacucuagauaucgaauuauuaaaaaccgaaguuacaaacccggccguauuacggaaauuguguauagaagccaaaauaaguaacacaacaacugauucaagauguccaacccaaggagaggcaacauuaguugaagaacaagacgcgaauuuuguauguagaagaacauuuguugacagaggaugggggaauggcugcggauuauuuggaaaaggaucauuaauaacaugcgcuaaauuuaaauguguaacaaaauuagaaggaaaaauaguacaauacgaaaaucuaaaauauagcguaauaguuacaguacauaccggagaucaacaucaaguuggaaacgaaucaacagagcauggaacaacggcaacaauaacaccacaggcaccaacaacagaaauacaauuaacagauuauggcgcuuuaacauuggauuguuuuccaaggacaggacuagauuuuaaugagaugguuuuauuaacaaugaaagagaaaagcugguuaguacauaaacaaugguucuuagauuuaccucucccauggacaaguggagcaaguacaagucaagaaacguggaacagacaagaucuuuuaguaacauucaaaacagcacaugcuaagaaacaagaagugguaguacuaggcucgcaagagggagcuaugcauacagcauuaacaggagcaacugagauacaaacaucaggaacaacuacaaucuuugcaggacauuuaaaauguaggcuaaaaauggauaaacuaacauugaaaggcauguccuauguaaugugcacaggaucuuucaaacuagaaaaagaaguagcagaaacucaacauggaacaguauuaguccaaauaaaauaugaaggaacagacgcaccauguaaaauaccauuuucuacucaagaugaaaaaggcgucacacaaaauggaaggcuaauaacagcuaauccaauagucacagauaaagaaaaaccuguaaacauagaagcugaaccaccuuucggugaaucuuacauaguaauaggagcaggagaaaaagcguuaaaauuaagcugguuuaaaaaggguucgaguaucggaaaaauguucgaggcaacagcaagaggagcgagaagaauggcaauucuuggagauacagcuugggauuuuggaagcauagguggaguauuuacaucuguuggaaaauuaguacaccaaauuuuuggaacagcauauggaguauuguuuucgggaguuucauggacuaugaaaauaggaauaggugucuuauuaacauggcuaggacuuaauucaagaucaacauccuuaucgaugacaugcauagcuguagggcuaguaacauuauaucuaggagucaugguacaagcguaa

SEQ ID NO: 2207 - RNA, 2043 nt, Artificial Sequence
  derived and/or modified CDS sequence (opt6) from DENV-1 CYD23__SSopt-prME(R188L)
augaaacgcaagaaaagcguaacaauguuacuaauguuaaugccaacagcacuagccuuucauuuaacgacaagaggaggagaaccgcauaugauagucaguaaacaggaaagagguaaaagccuauuguucaaaacaagugcaggagugaacauguguacucuaauagcuauggacuuaggagaauuaugugaggauacaaugaccuauaaaugcccuaggauaacagaagcagaaccagacgaugucgauugcugguguaaugcaacagacaccuggguaacauaugggacaugcagccaaacaggagagcauagaagggacaaacgaucaguagcacuagcgccacauguaggauuaggacuggaaacacgcacugaaacauggaugagcucagaaggagcauggaaacaaauacaaagaguagaaacaugggcacuacgacacccaggauuuacaguuaucgcacuauuucuagcacacgcgauaggaacaucaauaacucaaaaaggaauaauuuuuauucuuuugauguuagucacaccauccauggcaaugagauguguuggaauaggaucaagagauuucguagagggucuaagcggagcaacauggguagauguaguucuugaacacgguucuuguguaacaacaauggcgaaagacaaaccuacacuagauauugaauuacuuaaaacugaaguaacaaacccagccguucuaagaaaauuauguauagaagcaaaaauaaguaauacaacuacagauucgagauguccaacacaaggugaagcgacacucguagaagaacaggacgcaaacuucguauguagaagaacauuuguagauagagguuggggaaaugguuguggauuauuuggaaaaggaaguuuaauaacaugugcgaaauucaaaugcguuacaaaguuagaaggaaaaauuguacaauaugaaaaucuaaaauauucaguaauuguuacaguacacacaggagaucaacaccagguagguaaugaaucgacugaacacggaacuacagcuacaauuacaccacaagcaccaacaacggaaauacaacuaacagauuauggugcacuaacucuagauuguaguccucuaacgggucuagauuucaaugaaaugguacuauuaacaaugaaagaaaaaucauggcuaguacacaaacaaugguuuuuagaccuaccguuacccuggacaaguggagcaaguaccucacaagaaacguggaauagacaagaccuauuaguuacuuuuaaaacugcacaugccaagaaacaagaaguuguaguauugggaagucaagaaggagcaaugcacacagcuuuaacaggugcaacggaaauacagacaaguggcacuacgacaaucuucgcagggcacuuaaaauguagacuaaaaauggauaaauuaacacuaaaagggaugagcuauguaaugugcacagguagcuucaaacuagaaaaagaaguagcagaaacgcaacauggaacgguauugguacaaauuaaauaugagggaacagaugcaccauguaaaauaccauucucaacacaagacgaaaaaggaguuacacaaaauggacgauuaauaacagcgaauccaauagucacagauaaagaaaaaccaguuaacauagaagcugaaccaccuuuuggagaaucauauauaguaaucggugcuggagaaaaagcauuaaaauuaaguugguuuaagaaaggaucaucgauaggaaaaauguuugaagccacagcaaggggagcaaggaggauggccauacuaggagauacagcaugggauuuuggaucaaucggaggaguuuucacaucaguaggaaagcuaguacaucaaauuuuuggaacugcauacggagucuuauuuucgggaguaaguuggacaaugaaaauaggaauaggcguacuccuaacaugguuaggacuaaauucacgaagcacaucauuaaguaugacaugcauagcaguaggccuaguaacauuguaucuuggagugaugguacaagcauaa

SEQ ID NO: 2208 - RNA, 2043 nt, Artificial Sequence
  derived and/or modified CDS sequence (opt6) from DENV-1 CYD23__SSopt-pr(D104A)MEdelstem_TM,(F108S)-JEV
augaaaagaaagaaaagcguaacgauguuacuaauguuaaugccaacagcauuggccuuucacuuaacaacgagagguggagaaccacauaugauaguaaguaaacaagaacgaggaaaaucacuacuauuuaaaacaucagcaggaguaaacauguguacgcuaauugcaauggauuuaggagaauuaugugaagauacaaugacauauaaaugucccagaauaacggaagcagaacccgacgauguagauugcuggugcaaugcaaccgauacauggguaacauacggaacaugcucccaaacgggagaacacagacgagcaaaaagauccgucgcacuagcuccacacguuggacuaggacuugaaacaagaacagagacauggaugaguagugaaggggcauggaaacaaauacagagaguugaaacaugggcacuaagacauccaggauuuacagucauagcucucuucuuagcgcaugcuauuggcacaaguauaacgcaaaaaggaauaauauucauauuacuaaugcuaguaacaccgaguauggcaaugagauguguaggaauagguaguagggacuuuguagaaggauuaaguggagcuacuuggguugauguaguguuagaacaugguucgugcguaacaacaauggcaaaagauaaaccaacacuagauauagaauuacucaaaacugaaguaacaaaccccgcuguacuaaggaaauuguguauagaagcaaaaauaaguaauaccacaacagauucuagguguccaacacaaggagaagccacguuagucgaagaacaagaugcaaacuucguaugcagaaggacauuuguagacaggggauggggaaacgguuguggauuaaguggaaaaggaagucuaauaacaugcgcaaaauuuaaauguguuacuaaauuagaagguaaaauaguucaauaugaaaaccuaaaauacucaguaauagucacaguacacacgggagaucaacaucaagugggaaacgaguccacagaacacgguacaacugcaacaauaacaccacaagcuccaaccacagaaauccaauuaaccgauuacggagcuuuaacauuagauuguucaccuagaacaggacuagauuuuaacgaaaugguauuauuaacgaugaaagagaaaaguuggcuuguccauaaacaaugguuccuugaccuaccacucccauggacaucaggugcuucaaccucacaagaaacauggaauaggcaagauuuauuaguuacauucaaaacagcacaugcaaagaaacaagaaguaguaguauuaggcucacaagaaggcgcuaugcauacugcauuaacaggagcgacagagauucaaacaucaggaacuacaacuauauuugcaggacaucuaaaaugcagauuaaaaauggauaaacuaacacucaaagguaugucauauguuaugugcacaggaucuuuuaaauuagaaaaagaaguagcugaaacacaacaugguacaguguugguacaaauaaaauaugagggaaccgaugcaccuuguaaaauaccauuuucaacucaagacgaaaaaggaguaacucaaaauggaagauuaauaacagcuaauccaauaguaacggauaaagaaaaaccagucaauauugaagcggaacccccauucggagaaaguuauauagugaucggagcuggagaaaaagcgcuaaaauugagcugguucaagaaaggaucaacacuaggaaaagcguucaguacaacuuuaaaaggagcacaaaggcuagcagcucuaggggauacugcgugggauuuugggagcauaggaggaguguuuaacucaauagguagagcaguucaucaaguauuuggaggagcuuuccgcacacuauuuggagguaugaguuggauaacacaaggucuuaugggugcuuuacuauuauggauggguguaaaugcaagagacagaaguauagcauuagcauuuuuggcaacuggaggaguucuaguauuuuuagcaacaaacguacacgcauaa

SEQ ID NO: 2209 - RNA, 2043 nt, Artificial Sequence
  derived and/or modified CDS sequence (opt6) from DENV-1 CYD23__SSopt-prMEdelstem_TM,(H261N)-JEV
augaaacgaaagaaaucaguaacaauguuauuaaugcuaaugccuacugcauuagcauuucacuuaacaacacgaggaggagaaccacacaugauaguaaguaaacaagaacgaggaaaaaguuuauuauucaaaacaagcgcaggaguaaauauguguacauugauagcaauggaucuaggcgaauuaugcgaagauacgaugaccuacaaauguccaagaauaacagaagcagaaccugacgauguagauugcugguguaaugcaacagauacuuggguaacauauggaacauguagccaaacaggugaacauagacgagauaaaagaucaguagcauuagcgccucacguaggacuagguuuagaaacgagaacagaaacuuggaugaguagugaaggcgcuuggaaacaaauccaacgaguagaaaccugggcacuacgucauccaggcuuuacaguaauagcuuuauuuuuagcacacgcaauuggaaccucaauaacacaaaaaggaaucauauuuauucuacuaaugcuaguaacaccaucaauggcaaugagauguguggguauagguagcagggacuuuguagaaggcuuaucaggagcaacauggguagaugucguauuagaacauggaucauguguuacaacaauggcaaaagacaaaccaacauuggauauagaacuacuuaaaacugaaguaacgaacccagcuguacugagaaaacuauguauugaggcaaaaauuaguaacacaacuacggacaguagauguccaacucaaggagaagcuacccuaguggaagaacaagaugcaaacuuuguauguagaagaacauuuguagauagagguuggggaaauggaugcggacuauucggaaaaggaucauugauaacaugcgcuaaauuuaaauguguaacaaaauuggaaggaaaaauuguacaauaugaaaauuuaaaauacagugugauaguaacaguccacacaggagaccaacaccaaguaggaaacgaaucaaccgaacauggaacaacagcuacaauuacuccacaagcuccaacaacagaaauacaauuaacagacuauggagcucuaacacuagauugcucaccacgaacggggcuggacuuuaacgaaaugguacucuuaacaaugaaagagaaaaguuggcuaguacauaaacaaugguuuuuagaucuaccguuaccuuggacaucgggagcaaguacgucacaagaaacauggaauagacaagauuuauuaguaacauucaaaacagcacacgcaaagaaacaagaaguuguaguauuaggcucacaagaaggagcaaugaauacugcacuaacuggagcaacagaaauacaaacuucgggaacuacuacaauauuugcuggucacuuaaaaugucgauuaaaaauggauaaacuaacucuaaaaggcaugagcuauguaauguguacaggaucauuuaaauuagaaaaagaaguagcagaaacacaacaugguacaguguuaguacaaauaaaauaugaaggaacagaugcaccaugcaaaauaccauuuagcacgcaagaugaaaaaggagucacacaaaauggaagacuaaucacagccaacccgauuguaaccgauaaagaaaaaccaguaaauauagaagcagaaccaccguuuggagaaucauacauuguuauaggagcuggggaaaaagcccuuaaauuaaguugguuuaagaaaggaucaacauuaggaaaagcauuuaguacaacucuaaaaggagcacaaagacuagcugcgcuaggagauacugcaugggauuuuggaagcauaggaggaguguucaauaguaucgggagagcaguacaucaaguuuucggaggugcauuuagaacacuuuucgguggaaugucuuggauaacucaaggauuaaugggagcgcuuuuacuauggaugggagucaaugcaagggaccggaguauagcuuuagcauuuuuagcaacagguggaguucuaguauucuuagcaacaaauguacaugcauaa

SEQ ID NO: 2210 - RNA, 2043 nt, Artificial Sequence
  derived and/or modified CDS sequence (opt6) from DENV-1 CYD23__SSopt-prMEdelstem_TM,(R188L,A267T)-JEV
augaagagaaagaaaagugugacaauguuauuaauguuaaugccaacagcccuagcauuucaucuaacaacaagaggaggugaaccacauaugauuguuaguaaacaagaaagaggaaaaagucuauuauuuaaaacgagcgccggaguaaauaugugcacucuuauugcuauggauuugggcgaauuaugcgaagauacgaugacuuacaaaugcccaagaauaacagaagcagaaccagaugacguugauugcuggugcaacgcaaccgauacauggguaacauauggaacuugcucgcaaacaggugaacauagaagagauaaaagaucaguagcccuagcaccucacguaggacuaggacuagaaacucgaaccgaaacauggaugaguucagaaggagccuggaaacaaauacagcgaguggaaacgugggcacucagacacccaggcuuuacaguaauugcauuauuuuuggcacaugcuauaggaacaucaauaacacaaaaagguauuauauuuauacuguuaaugcuaguaaccccaucaauggccaugaggugcguagggauaggcucuagagauuuuguagaagguuuaagcggagcaacauggguagauguagucuuagaacacggaaguuguguaacaacaauggcgaaagacaaaccuacacuugauauagaacuucuaaaaacagaaguaacaaacccggcagugcuacgaaaauuauguauagaagcaaaaauaaguaauacaacaacugacagcagaugcccuacacagggagaagcaacauuaguagaagaacaagacgcgaacuuuguauguagaagaaccuucguagauagaggaugggggaacgguuguggauuauucgguaaagggucuuuaauaacaugcgcuaaauuuaaguguguaacaaaauuggaaggaaaaauaguccaauacgaaaaccuaaaauauucuguaaucgucacaguccacaccggagaucaacaccagguaggaaaugaaucaaccgaacauggaacaacagcuaccauaacgccacaagccccaacaacagaaauacaacuaaccgauuauggagcacuaacguuagacugcucuccacuaacuggcuuagacuuuaaugaaaugguccuauugacuaugaaagaaaagaguugguuaguacacaaacaaugguuucuagacuuaccacucccauggacgagcggagcaucaacuagccaagaaacauggaauagacaagaucuauuagucacauucaaaacagcucacgcuaagaaacaggaaguuguaguauuaggaucccaagaaggugcuaugcacacugcacuaacaggaacaacagaaauucaaacaagugguacaacaacaauuuuugcaggacaucuaaaaugcagauugaaaauggacaaauuaacauuaaaaggaaugagcuauguaauguguacaggaaguuuuaaacuagaaaaagaaguagcagaaacucaacacggaacuguauuaguacaaauaaaauaugaaggaacagaugcuccauguaagauaccuuucaguacacaagaugaaaaaggcguaacacagaacgggagacucauaacagcuaacccaauaguaacagacaaagaaaaaccgguaaacauagaagcugaaccaccauuuggagaaaguuauauagucauaggagcuggagaaaaagcucuaaaauuaucaugguucaagaaagguagcacuuuaggaaaagcauuuagcacaacacuaaaaggagcacaaaggcuagcagcacuaggagacacugcgugggauuucggaaguauaggaggaguauuuaauagcauagggagagcagugcaucaaguauuuggaggugcauucagaacauuauuuggaggaaugagcuggaucacacagggauuaaugggagcacuauuguuauggauggguguaaaugcaagagauagaucaauugcacuagcauuccuagcaacuggagguguacuuguauuuuuagcaacaaacguucaugcauag

SEQ ID NO: 2211 - RNA, 300 nt, Artificial Sequence
  derived and/or modified CDS sequence (opt6) from DENV-2 CYD2-T__C
augaacaaccaaagaaaaaaagcaaaaaacacaccauucaacaugcuaaaaagagaaagaaacagaguaagcacaguacaacaacuaacaaaaagauucagccuaggaaugcuacaaggaagaggaccacuaaaacuauucauggcacuaguagcauuccuaagauuccuaacaauaccaccaacagcaggaauacuaaaaagauggggaacaauaaaaaaaucaaaagcaauaaacguauuaagaggauucagaaaagaaauaggaagaaugcuaaacauacuaaacagaagaagaaga

SEQ ID NO: 2212 - RNA, 342 nt, Artificial Sequence
  derived and/or modified CDS sequence (opt6) from DENV-2 CYD2-T__C-SSc
augaacaaccaaagaaaaaaagcaaaaaacacaccauucaacaugcuaaaaagagaaagaaacagaguaagcacaguacaacaacuaacaaaaagauucagccuaggaaugcuacaaggaagaggaccacuaaaacuauucauggcacuaguagcauuccuaagauuccuaacaauaccaccaacagcaggaauacuaaaaagauggggaacaauaaaaaaaucaaaagcaauaaacguacuaagaggauucagaaaagaaauaggaagaauguuaaacauacuaaacagaagaagaagaucagcaggaaugauaauaaugcuaauaccaacaguaauggca

SEQ ID NO: 2213 - RNA, 273 nt, Artificial Sequence
  derived and/or modified CDS sequence (opt6) from DENV-2 CYD2-T__pr
uuucacuuaacaacaagaaauggagaaccacauaugauaguaucaagacaagaaaaaggaaaaagcuuacuauuuaaaacagaagauggaguaaacaugugcacacuaauggcaauggacuuaggagaacuaugugaagauacaauaacauauaaauguccauuacuaagacaaaaugaaccagaagauauagauugcuggugcaauagcacaagcacauggguaacauauggaacaugcacaacaaugggagaacacagaagagaaaaaaga

SEQ ID NO: 2214 - RNA, 225 nt, Artificial Sequence
  derived and/or modified CDS sequence (opt6) from DENV-2 CYD2-T__M
ucaguagcauuaguaccacauguaggaaugggacuagaaacaagaacagaaacauggaugucaucagaaggagcauggaaacacguacaaagaauagaaacauggauacuaagacauccaggauucacaaugauggcagcaauauuagcauauacaauaggaacaacacauuuccaaagagcacuaauauucauacuauuaacagcaguaacaccaucaaugaca

SEQ ID NO: 2215 - RNA, 498 nt, Artificial Sequence
  derived and/or modified CDS sequence (opt6) from DENV-2 CYD2-T__prM
uuccacuuaacaacaagaaacggagaaccacauaugauaguaucaagacaagaaaaaggaaaaagucuacuauucaaaacagaagacggaguaaacaugugcacacuaauggcaauggacuuaggagaauuaugcgaagauacaauaacauauaaaugcccauuacuaagacaaaaugaaccagaagacauagacugcuggugcaacagcacaagcacauggguaacauacggaacaugcacaacaaugggcgaacacagaagagaaaaaagaagcguagcauuaguaccacacguaggaaugggauuagaaacaagaacagaaacauggaugagcucagaaggagcauggaaacacguacaaagaauagaaacauggauacuaagacacccaggauucacaaugauggcagcaauacuagcauacacaauaggaacaacacacuuucaaagagcacuaauauucauauuacuaacagcaguaacaccaagcaugaca

SEQ ID NO: 2216 - RNA, 1485 nt, Artificial Sequence
  derived and/or modified CDS sequence (opt6) from DENV-2 CYD2-T__E
augagauguauaggaaugaguaauagagacuuuguagaaggaguaaguggaggaagcuggguagauauaguauuagaacacggaucaugcguuacuaccauggcaaaaaacaaaccaacauuagacuucgaauuaauaaaaacagaagccaaacaaccagcaacacuaagaaaauacugcauagaagcaaaacuuacaaauacuacaacagaaagucgaugcccuacacagggagaaccaaguuuaaacgaagaacaagauaaacgauucguaugcaaacacuccaugguugacagaggauggggaaacggauguggccuauuugguaaaggagguauaguaacaugugcaauguuuaggugcaaaaaaaacauggaaggaaaaguaguucagccagaaaaccuagaauauacaauaguaauaacaccacacaguggagaagaacaugccguaggcaaugauacaggaaaacauggaaaagaaauaaaaauaaccccccaaagcucaauaacagaagcggaauuaacaggauacggaacuguaacaauggaauguagcccaagaacuggauuagauuucaacgagaugguacuauuacaaauggaaaauaaagcauggcuaguacauagacaaugguuucuugaucuaccacuaccaugguuaccaggcgcagauacacaaggaucaaacuggauacaaaaagaaacucuaguaacauucaaaaacccacacgcaaaaaaacaagaugucguaguccucggaucacaagaaggagcaaugcauacugcacuaacaggagcaacagaaauucaaaugucaagcggaaaucuacuauucacaggacacuuaaaauguagacuaagaauggacaaacuacaacuaaaaggcaugucauauaguaugugcacuggaaaauucaaaguaguaaaagaaauagcggaaacacaacauggaacuauaguaauaagaguacaauaugagggagauggaaguccaugcaaaauacccuuugaaauaauggaucuagaaaaaagacacguccuaggaagauuaauaacagucaauccaauaguuacagaaaaagacaguccaguaaauauagaagcagaaccaccauucggagacagcuacauuauaauaggaguagaacccggacaauuaaaacuaaauugguuuaaaaaagguagcucaauuggacaaauguuugaaacaacaaugagaggugcaaaaaggauggcaauauuaggagauacugcaugggauuucggaagcuuaggaggaguauucacaucaauaggaaaagcucuacaucaaguguucggagcaaucuauggggcugcauucagcggaguaucauggacaaugaaaauauuaauagguguaauaauaacauggauuggaaugaauucacgaucaacuagcuugagcguaaccuuaguauuaguugggauaguuacauuauaucuaggaguaaugguacaagca

SEQ ID NO: 2217 - RNA, 1983 nt, Artificial Sequence
  derived and/or modified CDS sequence (opt6) from DENV-2 CYD2-T__prME
uuucaccuaacaacacgcaauggagaaccucauaugauagucucacgacaagaaaaaggaaaaaguuuguuauuuaaaacagaagauggaguuaauauguguacauuaauggcaauggaccuaggagaauuaugugaagacacaauuaccuauaaauguccacuauuaagacaaaaugaaccugaagacauugauuguuggugcaacucaacuucaacuuggguaacauacggaacuuguacaacaaugggcgaacauaggcgugagaaaagaaguguagcccuaguaccacacguuggaaugggacuugaaacucgaacggaaacauggaugagcucagaaggagcauggaaacacguacaacgaauagaaacauggauauuaagacauccagguuucacaaugauggcagcaauacuugcauauacaauagggacuacacauuuucaaagagcacuaauauuuauauuguugacagcagugacaccaucgaugacaaugagaugcauaggcaugaguaauagagauuuuguagaaggagugaguggagguucauggguagauauaguuuuagaacauggaaguugcguuacaacuauggcuaaaaauaaaccaacauuggacuuugaacuaauuaaaacagaagcaaaacaacccgcaacgcucaggaaauacuguauagaagcaaagcuaacaaacacaacaacagaaagcagauguccaacacaaggagaaccauccuuaaaugaagaacaagauaaaagauuuguuugcaaacacucaaugguggacagagguugggguaacggauguggacuauuuggaaaaggagguauuguaacuugugcaauguucagauguaagaaaaauauggaaggaaaaguaguccaaccagaaaaccuagaauacacaauaguaauaacuccccauucaggagaagaacacgcaguaggcaacgauacgggaaaacauggaaaagaaauaaaaauaacaccucagagcaguauaacagaagcagaacuuaccggauaugguacaguuacaauggaauguagcccaaggacaggcuuggacuuuaaugaaaugguauuauuacaaauggaaaacaaagcaugguuaguacaucgacaaugguuucucgauuuaccccuaccauggcuacccggagcugacacccaaggcaguaauuggauacaaaaagaaacucuaguuaccuucaaaaauccgcaugcaaagaaacaggauguaguaguuuuagggagccaagaaggugcuaugcacacagcguuaacaggagcgacagagauacaaaugucaagugguaaucuguuauuuacaggacaucuaaaaugcagguuaagaauggacaaauugcaauuaaaaggaaugaguuacucaaugugcacagggaaauuuaaaguaguaaaagaaauugcagaaacucaacauggaacaauaguaauaagaguucaauaugaaggagacggaagcccuugcaaaauaccauuugaaauaauggauuuagagaaaagacauguauuaggaagauuaauuacuguaaauccgauaguaacagaaaaagauucaccaguaaauauagaagcugaaccgccuuuuggagauaguuauauaauaauaggaguagaaccaggacaauuaaaauuaaauugguucaagaaaggaaguagcauaggacaaauguucgaaaccacaaugagaggggcaaaaaggauggcaauacuaggagauacugcgugggauuuuggaucacuaggaggaguauucacaagcauaggaaaagcacuacaccaaguauucggagcuauauacggcgcagcauuuaguggcguauccuggacaaugaaaaucuuaauaggcguaauaauaacauggauaggaaugaacagucgaucaaccagcuuaaguguaacauuaguauuaguaggaauaguaacacuauaccuaggaguaaugguacaagcc

SEQ ID NO: 2218 - RNA, 2025 nt, Artificial Sequence
  derived and/or modified CDS sequence (opt6) from DENV-2 CYD2-T__SSc-prME
agcgcaggaaugauaauaauguuaauaccuacugucauggcauuucaucuuacaacaagaaacggggaaccacauaugauaguuagccgucaagaaaaagguaaaaguuuauuauuuaaaacugaagauggaguaaauauguguaccuuaauggcaauggaucuuggcgaauuaugcgaagauacaauuacauauaaauguccauuauuacgacaaaaugaaccagaagacauagauuguuggugcaauucaacaagcacuugggugacguacgguacaugcaccacaaugggagaacauagaagagaaaaaagaucaguggcacugguuccacacguaggaaugggauuagagacaagaacagaaacauggaugucaagugaaggagcauggaaacauguacaaagaauagaaacauggauacuccgacauccagguuuuacaaugauggcagcuauuuuagcauauacaauaggaacuacacauuuccaaagagcauuaauuuuuauacuauuaacagcaguaacucccucaaugacaaugagauguauaggaaugucgaauagagauuucguagaaggaguuucagguggaagcuggguagacauaguuuuagaacauggaucaugcguaacgacaauggcaaaaaacaaaccaacacuugauuucgaauuaauaaaaacugaagcaaaacaacccgcaacacugaggaaauauuguaucgaagcaaaauuaacaaacacuacuacugaaaguagauguccaacacaaggcgaaccaagccuaaaugaagaacaagauaaaagauucgucugcaaacauagcaugguugacagaggauggggaaauggaugcgguuuauucggaaaaggagguauaguaacuugugcuauguuuaggugcaaaaaaaauauggagggaaaaguaguacaaccugaaaaucuagaauauaccauugugauuacgccacauaguggugaagaacaugcuguagguaaugauaccggaaaacacggaaaagaaauaaaaaucacaccucaaaguaguauaacagaagcagaacuaacaggauauggaacaguaacgauggaaugcuccccaagaacuggccuagauuuuaaugaaaugguacuacuacaaauggaaaauaaggcauggcuuguccauagacaaugguuucuugaccugccacuuccaugguuaccaggagcugauacccaaggaucaaacuggauacaaaaagaaacacuaguaacauuuaaaaauccucacgcaaaaaaacaagauguaguaguauuaggaucacaagaaggagcaaugcauacagcacuaacaggagcaacagaaauacaaaugucaaguggaaauuuacuuuuuacgggacauuuaaaauguagacuuagaauggacaaauuacaauuaaaagguaugaguuauucgauguguacaggaaaauucaaaguaguaaaagaaauagcagaaacacaacacgguacaauaguaauacgaguacaauaugaaggcgauggaucacccugcaaaauaccauucgaaauaauggacuuagaaaaaagacacguucugggaagauuaauuacaguaaaucccauaguaacagaaaaagacaguccagugaauauugaagcagaaccaccauuuggagauaguuauauaauaauaggaguugaaccaggucaauuaaaacuaaacugguuuaaaaaaggaucaaguauaggccaaauguucgaaaccacuaugcgaggugcaaaacgaauggcgauacuaggagauacagcaugggauuuuggaucacuaggaggaguuuuuacuaguauagguaaggcacuucaucaaguauucggagcaauauauggagcagcauuuucaggaguaucauggacaaugaaaauuuuaaucggaguaauaauaacauggauagguaugaauucaagauccacuucguuaagugucacguuaguuuuaguaggaauaguaacccucuauuuaggaguaaugguacaagcc

SEQ ID NO: 2219 - RNA, 2325 nt, Artificial Sequence
  derived and/or modified CDS sequence (opt6) from DENV-2 CYD2-T__C-prME
augaacaaccagaggaaaaaggcuaaaaacacuccauuuaacaugcuaaaaagagaaagaaauagaguauccacuguacagcaguuaaccaagagauuuagucuaggaauguuacaagguagaggaccauuaaaacuuuuuauggcccuaguagcauuuuuaagauuccuaacaaucccacccaccgcagggauccuuaaaagauggggcaccauaaagaaaucaaaagcaauuaauguccuaagagguuucagaaaagaaauaggaagaaugcuaaauauuuuaaauagaagaagaagaucagcaggaaugauaauaauguuaauacccacaguaauggcauuccaccuaacuacuagaaauggggaaccacauaugaucguaucuaggcaagaaaaaggaaaaucccuauuauuuaaaacagaagacggaguaaauauguguacauuaauggccauggauuuaggagaauuaugugaagauacuauuacauauaaauguccacuguuaagacaaaacgaaccugaagacauugauuguuggugcaauucaacaaguacuuggguaacuuauggaacaugcacaacgaugggagaacauagacgugagaaaagaagcguagcucuagucccacauguaggaauggguuuagaaacacgaacagaaacauggaugucgucagaaggagcuuggaaacauguacaacgaauagaaacauggauauuaagacauccaggauuuacaaugauggcagccauauuagcauauacaauaggaacaacacacuuucaacgugcacuuauauuuauacuacuaacugcaguaaccccaagcaugacaaugagaugcauaggcaugaguaauagagauuucgucgaaggaguuucagguggaaguuggguagacaucguacuagaacauggauccuguguaacuacuauggcuaaaaauaaaccaacacuugauuuugaauuaauaaaaacagaagccaagcaaccagcuacuuuaaggaaauacugcauagaagcaaaauuaacaaauacaacuaccgaaucucgauguccaacacaaggggagccgucauuaaacgaagaacaagauaaacgauuuguauguaaacauucuaugguagacagaggauggggaaacggauguggacuauucggaaagggagguauagucacuugugcaauguuuagauguaagaaaaauauggaagguaaaguuguacaaccagaaaaccucgaauauacaauaguaauaacaccucauucaggagaagaacaugcaguaggaaacgauacuggaaaacauggcaaagaaaucaaaauaacgccucaaagcagcauuacugaagcagaacuuacuggauacggaacuguaacaauggaaugcaguccaagaaccggacucgauuuuaaugaaaugguacuacugcaaauggaaaauaaagcgugguugguacaucgccaaugguucuuagauuuacccuugcccuggcuaccaggggcagacacacaaggaaguaacuggauacaaaaagaaacuuuaguaacauuuaaaaacccucacgcaaagaaacaagauguaguaguauuaggaucucaagagggagcaaugcauaccgcucuaacaggcgcaacugaaauacaaaugaguaguggaaauuuauuauuuacuggacaucugaaauguagacuuagaauggacaaacuacaacucaaaggaaugaguuauagcauguguacaggaaaauuuaaaguagucaaagaaauugcagaaacacaacauggaacaauaguaauaagaguucaauaugaaggcgauggaucaccauguaaaauacccuuugaaauuauggacuuagagaaaagacacguauuaggacgauuaauaacaguaaauccaauugugacagaaaaagauucaccagucaacauagaagcagaaccuccauuuggcgacagcuacauuauaauuggaguugaaccaggacaauuaaaauuaaacugguuuaagaaagguucuucaauuggacaaauguucgaaacaacaaugcgaggagcaaaaagaauggcaauauuaggagauacagcaugggauuucggaucauuagguggaguauucacgucaauaggcaaagcgcuacaucaaguuuucggggcaauauacggagcagcauuuuccggaguuucauggacaaugaaaauacuaauuggaguaauaauaaccuggauaggaaugaauagcagaucgacuagccuauccguuacccuagucuuaguaggaauaguaacacuauaucuaggcguaaugguacaagca

SEQ ID NO: 2220 - RNA, 45 nt, Artificial Sequence
  derived and/or modified CDS sequence (opt6) from DENV-2 CYD2-T__SSc
augagcgcaggaaugauaauaauguuaauaccgacaguaauggca

SEQ ID NO: 2221 - RNA, 57 nt, Artificial Sequence
  derived and/or modified CDS sequence (opt6) from DENV-2 CYD2-T__SSopt
augaaaagaaaaaaaagcgcaggaaugauaauaauguuaauaccgacaguaauggca

SEQ ID NO: 2222 - RNA, 57 nt, Artificial Sequence
  derived and/or modified CDS sequence (opt6) from DENV-2 CYD2-T__SSm
auguuucaacgugcacuuauauuuauacuucuaacugcagucacaccuucaaugaca

SEQ ID NO: 2223 - RNA, 1488 nt, Artificial Sequence
  derived and/or modified CDS sequence (opt6) from DENV-2 CYD2-T__E
augagaugcauaggaaugagcaacagagacuucguagaaggaguaaguggcggaaguuggguagauauaguauuagaacaugguaguuguguaacaacaauggccaaaaauaaaccaacauuagauuuugaauuaauaaaaacagaggcaaaacaaccagcaacacuaagaaaauauugcauagaagcaaaauuaacaaauacaacaacagaaagcagaugcccaacacaaggagaaccaaguuuaaaugaagaacaagacaaaagguuuguauguaaacauagcaugguagauagaggauggggcaauggaugcggacuuuuuggaaaaggaggaauaguaacaugcgcaauguuuagauguaagaaaaauauggaagguaaaguaguacaaccagaaaaucuagaauacacaauaguuauaacuccgcauaguggagaagaacacgccgugggaaaugauacaggaaaacacggaaaagaaauaaaaauaacaccacaaagcucaauuacggaagcugaguuaacaggauauggaacuguaacaauggaauguaguccaagaacaggauuagauuucaaugaaaugguacuacuacaaauggaaaauaaagcauggcuaguacaucgacaaugguuucuagacuuaccuuuaccauggcugccaggagcagauacacaagguucaaauuggauacaaaaagaaacauuaguaacauuuaaaaauccacacgcaaagaaacaagauguaguaguuuuagguagucaagaaggcgcaaugcauacagcacugacaggagcgacugaaauacaaaugucaagcggaaauuuacuauuuacaggacauuuaaaauguagauugagaauggauaaauuacaacuaaaaggaaugagcuauucaauguguacaggaaaauuuaaaguaguaaaagagauagccgaaacucaacacggaacaauaguuaucagaguacaauaugaaggggauggaagcccauguaaaauaccauuugaaauaauggauuuagagaaaagacauguauuaggaagguuaauaacaguaaauccaauuguaacggaaaaagauucaccaguuaauauagaagcagaaccuccauuuggagauagcuacauaauaauuggaguagaacccggacaacuaaaguuaaauugguucaagaaaggaaguucaauaggucaaauguuugaaacaacuaugagaggagcaaaaagaauggcuauauuaggugauacagcaugggauuuuggaucuuuaggaggaguauuuacaucaauaggaaaagcacuacaccaaguauuuggagcuauauauggagccgcauuuaguggaguaagcuggacaaugaaaauacuaauuggagugauaauaacauggauugguaugaauaguagaucaacaucacuaaguguaacucuaguccuaguaggaauaguaacauuauaucuaggaguaaugguucaagcguaa

SEQ ID NO: 2224 - RNA, 1182 nt, Artificial Sequence
  derived and/or modified CDS sequence (opt6) from DENV-2 CYD2-T__EdelTM-variant (aa1-394)
augcgaugcauaggaaugagcaacagagacuuuguagaaggcguaaguggaggcaguuggguugacauagucuuagaacauggaucaugcgucacaacaauggcaaaaaauaaaccaacccuagauuuugaauuaauaaaaacagaagccaaacaaccagcaacacuuaggaaauacugcauugaagcgaaauuaacaaauacaacuacugaaagcagaugcccaacccaaggagaaccaagccuaaaugaagaacaagacaaaagauucguaugcaaacacucuaugguagacagaggcuggggaaauggauguggauuauucggaaaaggaggaauaguuacaugcgcaauguuuagauguaaaaaaaacauggaaggaaaaguuguacaaccugaaaacuuagaauauacaauaguaaucacaccacauagcggagaagaacaugcaguaggaaacgauacagguaaacacggaaaagaaauaaaaaucacaccacaaagcaguauaacagaagcagaauuaacaggauacggaacaguuacaauggaauguagcccaagaacaggacuagacuuuaaugaaaugguacuacuacaaauggaaaauaaagcgugguuaguacauagacaaugguuucuagaucuuccucuaccaugguuaccaggagcagauacacaaggaucaaacuggauacaaaaagaaacauuaguaaccuucaaaaacccacacgcuaaaaaacaagauguaguaguauuaggaucacaagaaggcgcaaugcauacagcauuaacuggcgcaacagaaauacaaaugucuucaggaaaccuacuauucacaggacaccuaaaaugcagacuucgaauggacaaacuacaauuaaaaggaaugaguuacucaaugugcaccggaaaauucaaaguaguaaaagaaauagcagaaacacaacauggaacaauaguuauaagaguccaauacgaaggagaugguucaccauguaaaaucccauuugaaauaauggaccuagaaaaacgucacguuuuaggaagauuaauaacaguaaacccaauaguaacagaaaaagacagcccaguaaacauagaagcagaaccuccauuuggagauagcuauauaauaauagggguagaaccaggucaacuaaaauuaaauugguuuaaaaaa

SEQ ID NO: 2225 - RNA, 1272 nt, Artificial Sequence
  derived and/or modified CDS sequence (opt6) from DENV-2 CYD2-T__EdelTM-variant (aa1-424)
augagauguauaggaaugucaaacagagacuuuguagaaggaguaagcggaggaaguuggguagacauaguauuagagcauggcaguugcguaacaacaauggcaaaaaauaaaccaacccuugacuuugaacuaauaaaaaccgaagccaaacaaccagcaacccuaagaaaauauuguauagaagcaaaauuaacuaacacaacaacggaaagcagaugcccaacacaaggagaaccaucacuaaaugaagaacaagauaaaagauucguuugcaaacauucaaugguagacagaggauggggaaauggauguggacuuuucggaaaaggaggcauaguaacaugcgcaauguuuagaugcaaaaaaaacauggaaggaaaaguaguccaaccagaaaacuuagaauacacaauaguaauaaccccacauagcggcgaagaacaugccguaggaaaugacacaggaaaacauggaaaagaaauaaaaauaacaccccaaaguaguaucacagaagcagaacuaaccggauauggaacaguaacaauggaaugcaguccaagaacaggauuagacuucaacgaaaugguacuccuacaaauggaaaauaaagcauggcuaguacacagacaaugguuucuugacuuaccacucccauggcuaccaggagcagauacacaaggaaguaacuggauacaaaaagaaacacuaguaacauuuaaaaauccgcacgcaaaaaaacaagauguaguagucuuaggaucacaagaaggagcaaugcauacagcauuaacaggagcuacagaaauucaaaugagcagcggaaaccuauuauuuacaggacaccuaaaauguagacuaagaauggauaaauuacaauuaaaaggaaugagcuauucaauguguaccggaaaauuuaaaguagugaaagaaauagcagaaacacaacauggaacaauaguaauacguguucaauacgaaggagacggaucaccaugcaaaauaccauuugaaauaauggaucuagaaaaaagacacguauuaggaagacuaauaacagucaauccaauaguaacagaaaaagacucaccaguaaauauagaagcagaaccaccauucggagauagcuauauaauaauaggaguagaaccaggacaauuaaaauuaaauugguucaaaaaagguagcagcauaggacaaauguucgaaaccacaaugagaggagcaaaaagaauggcaauuuuaggagacacagcaugggauuucggauca

SEQ ID NO: 2226 - RNA, 1263 nt, Artificial Sequence
  derived and/or modified CDS sequence (opt6) from DENV-2 CYD2-T__EdelTM-variant (aa1-421)
augagauguauagguaugucgaacagagacuuugucgaaggagugaguggaggaaguuggguagacauaguauuagaacauggcucaugcguaacaacaauggcaaaaaauaaaccaacacuggacuuugaauuaauaaaaacagaagcaaaacaaccagcaacauuaaggaaauacugcauagaagcaaaauuaacaaauacaacaacagaaaguagaugcccaacacaaggagaaccaucauuaaaugaagaacaagauaaaagauuuguauguaaacacaguaugguagauagaggauggggaaauggaugcggacuauuuggaaaagggggaauaguaaccugugcaauguuuagauguaaaaaaaacauggaaggaaaagugguacaaccagaaaaccuagaauacacaauaguaauaacaccacacucaggagaagaacaugcaguuggaaaugacacaggaaaacauggaaaagaaauaaaaaucacaccccaaagcucaauaacagaagcagaacuaaccggguacggaacaguaacaauggaauguagcccaagaacaggacuagacuuuaaugaaaugguacuacuacaaauggaaaauaaagcaugguugguacacagacaaugguuuuuagaucuaccauugccaugguuaccaggggcagauacacaaggaucaaauuggauacaaaaagaaacauuaguaacguuuaaaaauccacacgcuaaaaaacaagauguaguaguauuaggaagucaagaaggggcuaugcauacagcauuaacgggagcaacagaaauucaaaugucaucagguaacuuacuauuuacaggacacuuaaaauguagacuacgaauggauaaacuacaacuuaaaggcaugagcuacagcauguguacgggaaaauuuaaaguaguaaaagagauugccgaaacucaacauggaacuauaguaaucagaguacaauaugaaggagacggaaguccuugcaaaaucccauuugaaauaauggauuuagaaaaaagacacguguuaggaagauuaauaacaguaaauccaauagugacagaaaaagacagcccaguaaacauagaagcugaaccacccuuuggagauagcuacauaauaauaggaguagaaccaggacaauuaaaauuaaacugguucaaaaaaggaucaucgauaggacaaauguuugaaacaacaaugagaggagcgaaaagaauggcaauauuaggagacaccgcuugggau

SEQ ID NO: 2227 - RNA, 2031 nt, Artificial Sequence
  derived and/or modified CDS sequence (opt6) from DENV-2 CYD2-T__SSc-prME
augucagcugguaugauaauaauguuaauaccaacaguaauggcauuccauuuaacuacgaggaauggagaaccucacaugauaguaucaagacaggaaaaagguaaaagucuauuauuuaaaacagaagauggaguuaauauguguacauuaauggcaauggacuuaggcgaauuaugugaagauacuaucacuuauaaauguccgcuacucagacaaaaugaacccgaagacauagauuguuggugcaauaguacaaguacaugggugacauacggaacauguacaacaaugggagaacauagaagagagaaaagauccguagcauuaguaccacauguaggaaugggacuagaaacacgaacagaaacauggaugucaucagaaggagcguggaaacaugugcaaagaauugaaacauggauucucagacauccaggauuuacaaugauggcagcuauacuagcauauacaauaggaaccacucacuuccaacgugcucuaauauuuauauuauugacugcaguaacaccaaguaugacaaugagaugcauaggaaugaguaauagggacuuuguagaaggaguaucaggaggaucauggguagauauaguauuagaacacggcaguuguguuacaacuauggccaaaaauaaaccaacacuagauuuugaacuaauaaaaacagaagcuaaacaaccagccacuuuaagaaaauauuguauugaagcaaaacuaacuaauacuacuacagaaucaagguguccaacccaaggagaaccaucuuuaaacgaagaacaagacaaacguuucguuuguaaacauaguaugguagauagagguuggggaaauggaugcgguuuauuuggaaaaggcggaauaguaacaugugcaauguuucgauguaagaaaaauauggaaggaaaaguuguacaaccagaaaaucuagaauauacaauaguuauaacaccucacucaggagaagaacacgcaguagguaacgauacuggaaaacaugggaaagagauuaaaauaacaccacaaaguucaauaacugaggccgaacuaacaggauaugguacaguaacaauggaaugcaguccaagaacagguuuagacuuuaacgaaaugguacuauuacaaauggaaaauaaagcauggcuaguacauagacaaugguuuuuagauuuaccucuaccauggcuaccgggugcugauacacaaggcucaaauuggauucaaaaagaaaccuuaguaacuuuuaaaaacccccacgcuaagaaacaagauguaguuguauuaggaucacaagaaggagcaaugcauacagcacuaacaggagccacagaaauacaaaugucuucuggaaacuuauuauuuacaggacaucuaaaauguagauuaagaauggauaaacuucaauuaaaagguaugucuuauucaauguguaccggaaaauuuaaaguagucaaagaaauagcagaaacacaacauggaacaauaguaauaagaguccaauaugaaggagaugggagccccuguaaaauaccauuugaaauaauggauuuagagaaaagacauguauuaggaagauuaauaacaguaaauccaauaguaacagaaaaagauagcccaguaaauauagaagcagaaccaccauuuggagauucuuauauaauaauaggaguagaaccaggacagcugaaauuaaauugguuuaagaaaggaaguucaauaggccaaauguuugaaacuacaaugcguggagccaaaaggauggcaauacugggagacacagcaugggauuucgguagucuaggaggagucuuuacgagcauaggaaaagcacuucaucaaguauuuggagcaaucuacggagcagcauuuagcggaguaucauggacaaugaaaauacuaauaggaguaauaauuacuuggauaggaaugaacucacgaucaacaucacucaguguuacucuaguauuaguagguauaguaacauuauaucuugggguuaugguacaagcauag

SEQ ID NO: 2228 - RNA, 2031 nt, Artificial Sequence
  derived and/or modified CDS sequence (opt6) from DENV-2 CYD2-T__SSc-prME(F108S)
augucagcaggaaugaucauaauguuaauaccuacaguaauggcuuuucaccuuacaaccagaaacggugaaccacacaugaucguaagcagacaggagaaaggaaaaagucuauuauucaaaacagaagauggaguaaauaugugcacguuaauggcaauggaucuaggggaacuaugcgaagauacaauaaccuauaaguguccucuacuaagacaaaaugaaccagaagacauagauuguugguguaacaguacaucaaccuggguaacguaugguacaugcacaacaaugggggaacauagaagggagaaaagaagcguagcuuuaguuccucauguaggcaugggauuagaaacuagaacggaaacauggaugaguagugaaggagcauggaaacauguucaaagaauagaaacauggaucuuaagacacccgggauuuacaaugauggcagcuauacuagcauacacaauaggaacaacacauuuccaaagagcauuaauauuuauacuacuaacagcaguuacaccaucaaugacuaugagauguauagguaugaguaaucgagauuucguagaagggguuagcgguggaucauggguagacauuguguuagaacauggaaguuguguuacaacuauggcuaaaaauaaaccuacauuagacuuugaauuaauaaaaacagaagcaaagcagccagcuacuuuaagaaaauacuguauagaagcaaaacuaacaaacacaacuacagaaagucgguguccaacucaaggagaaccuucacuuaaugaagaacaagacaaaagauuuguaugcaaacauaguaugguugauagaggauggggaaaugguuguggacuuaguggcaaagguggcauaguaacaugugcaauguucagauguaagaaaaauauggaagggaaaguaguucaaccagaaaacuuagaauauacaauaguaauaacaccacacuccggagaagaacaugcugucgggaaugacacuggaaaacauggaaaggaaauuaaaaucacuccgcaaagcagcauaacagaagcagaguuaacaggcuauggaacaguaacaauggaauguagucccagaacaggauuagauuucaaugaaaugguguuauuacaaauggaaaacaaagcaugguuaguacauagacaaugguuccuugaucuaccuuuaccauggcucccaggagcagacacucaaggauccaauuggauacaaaaagaaacuuugguaacauuuaagaacccacaugccaaaaagcaagauguaguuguauuaggaagucaagaaggagcaaugcauacugcacuaaccggagcuacagaaauacaaaugaguucgggaaacuuacucuuuacuggacaccuaaaauguagacuuagaauggauaaauugcaauuaaaaggaaugucauacucaaugugcacgggaaaauuuaaaguuguaaaagaaauagcagaaacacaacauggaaccauaguaauaagaguacaauaugaaggagauggaagcccauguaaaauaccauuugaaaucauggaucucgagaaaagacacguguuagguagauugauuacaguaaacccaauagucacagaaaaagauucccccguaaacauagaagcugaaccacccuuuggggauucauauauaauaauaggaguagaaccaggacaacuaaaacuaaacugguuuaagaaagguucaagcauaggacaaauguuugaaacaacaaugagaggagcaaaaagaauggcaauauuaggugacacagcaugggauuuugguucacuaggaggagucuucacaucaauuggaaaagcccuacaucaggucuuuggagcaauauauggggcagcauuuucaggaguaucauggacgaugaaaauauuaauaggaguaauaauaacauggauaggaaugaauaguagaucaacaucauuaaguguuacucuaguauuagucggcauaguaacauuguauuuaggaguaaugguacaggcauag

SEQ ID NO: 2229 - RNA, 2031 nt, Artificial Sequence
  derived and/or modified CDS sequence (opt6) from DENV-2 CYD2-T__SSc-prMEdelstem_TM-JEV
augagugcuggaaugauaauaauguuaauacccacuguaauggcauuucauuuaacuacaagaaauggagaaccacacaugauuguaaguagacaagaaaaagguaaaucuuuacuauuuaaaacggaagacggaguaaauauguguacacuaauggcaauggaccuaggagaacuaugugaagacacaauaacguacaaauguccauuacuaagacaaaaugaaccagaagacauagauuguuggugcaauaguacgaguacuuggguaacuuaugguacaugcacgacuaugggagaacacaggagggagaaaagaagcguagcucuaguaccccacguaggaaugggacuagaaaccagaacugaaacauggaugagcagcgaaggagcguggaaacauguccagcgaauagaaacuuggauauuaagacacccaggauuuacaaugauggcagcaauauuagcauauaccauaggaacuacucauuuucaaagagcacuaaucuucauauuacuaacagcuguaacuccgaguaugacaaugaggugcauaggaaugucaaauagagacuuuguugaaggaguuaguggaggauccuggguagauauaguauuagaacauggcucaugcguuacaacaauggcuaaaaacaaaccaacacuagauuuugaauuaauaaaaacagaagcaaaacaaccagcaacauuaagaaaauacuguauugaagccaaauuaacuaacacaacuacagaaaguagauguccaacacaaggagaaccaucacugaacgaagaacaagauaaaagauucguauguaaacauaguaugguagaucgaggauggggaaauggaugcggacuauuugggaaaggcgguauaguaacaugugcaauguuucgauguaagaaaaauauggaaggaaagguaguacaaccugaaaaucuagaauacacaauaguaauaacaccccauaguggagaagaacacgccguaggaaacgauaccggaaaacauggaaaagaaauaaaaauuacaccacaaaguaguauaacagaagcagaauuaaccggcuauggaacuguaacuauggaauguaguccaagaacaggauuagauuucaaugaaaugguacuacuacaaauggaaaacaaagcaugguuaguacaccgacaaugguuccuagauuuaccacuuccauggcuaccgggagcugauacacaaggauccaauuggauucaaaaagaaacauuaguaacauuuaaaaacccacacgcaaagaaacaagaugucguaguuuuaggaagucaagaaggagcaaugcauaccgcacugacaggagcaacagaaauacaaaugaguucaggaaaccuauuauuuacaggccacuuaaaauguaggcuacgaauggacaaauugcaacucaaaggaaugaguuacagcauguguacuggcaaauuuaaaguagucaaagagaucgcagaaacacaacacggaacuauaguaauacgaguacaauaugaaggcgaugguagcccauguaaaauaccauuugaaauaauggauuuagagaaaagacauguauuaggaagacuaauaacaguaaauccuauuguaacagaaaaagauucaccggucaacauagaagccgaaccacccuuuggugauucuuacauaauaauaggcguagaacccggucaacucaaauuaaauugguucaagaaaggaagcacacuagguaaagcauucucuacaacauuaaaaggagcccaaagguuagcagcauuaggagauacugcuugggacuucgggucaaucggaggcguauucaacuccauagguagagcaguacaucaaguuuucggaggagcguuccgaaccuuguuuggaggaaugagcuggauaacacaaggcuuaaugggagcauuacuauuauggaugggaguaaacgcuagagauagguccauugcucuugccuuucuagcaacaggaggaguucuaguauuuuuagcuacaaauguacaugcauaa

SEQ ID NO: 2230 - RNA, 1332 nt, Artificial Sequence
  derived and/or modified CDS sequence (opt6) from DENV-2 CYD2-T__SSm-EdelTM
auguuucaaagagcauugaucuuuauacugcuaacagcaguaacaccaagcaugacaaugagaugcauagguaugucaaacagagauuuuguagaaggaguaagcggaggcucauggguagauauaguacuagaacaugguucaugcguuacaacaauggcaaaaaacaaaccaacauuagauuuugaacuaauaaaaacagaagccaaacaaccagcaacucuaagaaaauauuguauagaagcaaaauuaacaaauacuacaaccgaauccagauguccaacccaaggagaaccaagucuaaacgaagaacaagauaaaagauuuguauguaaacacucaaugguagacagaggauggggaaauggcuguggacuauucggcaaaggaggcauaguaacaugcgcaauguucaggugcaaaaaaaauauggaagguaagguaguacaaccagaaaaccuagaauauacaauuguaauuacaccacauucaggagaagaacaugcaguagguaaugacacagguaaacacggaaaagaaauaaagauaacaccacaaucaaguauaacagaagcugaauuaacaggauacggaacaguaacaauggaauguucaccgaggacaggacuagacuuuaacgaaaugguacucuuacaaauggaaaauaaagcauggcuaguacauagacaaugguucuuagauuuaccauuaccuugguuaccaggagcagauacacaaggcagcaauuggauacaaaaagaaacacuaguaacauuuaaaaacccacacgcuaaaaaacaagacguaguaguacuuggaucacaagaaggcgcaaugcauacagcauugacaggagcuacagaaauacaaaugaguucaggaaacuuacuauucacaggacacuuaaaauguagacuaagaauggacaaauuacaacuaaaaggaaugaguuauagcauguguacuggaaaauucaaaguaguuaaagaaauagccgaaacacaacacgguacaauaguaauaagaguacaauacgaaggagauggcaguccauguaaaaucccuuuugaaauaauggacuuagaaaaacgacacguacuaggaagauuaauaacaguaaauccaauaguaacugaaaaagauucaccaguaaacauagaagcagaaccacccuuuggagauucauacauaauaauuggaguagaaccaggacaacuuaaacuaaacugguuuaaaaaaggaucaaguauaggacaaauguuugaaacaacaaugagaggcgcaaaaagaauggcaauccuaggugauacugcaugggauuuugggucauaa

SEQ ID NO: 2231 - RNA, 2379 nt, Artificial Sequence
  derived and/or modified CDS sequence (opt6) from DENV-2 CYD2-T__C-P2A-SSc-prME
augaacaaccaaagaaagaaagccaaaaauacgccuuucaauaugcuaaaaagagaaagaaauagaguaucuacaguacaacaacucacaaaaagauuuagucuuggaaugcuacaaggcagaggaccuuuaaaauuauucauggcucuaguugcauuucuaagauuucuuacaauaccacccaccgcaggaauacuaaaacgauggggaacuauaaagaaaagcaaagcuauaaacguauuaagaggguuuagaaaagagaucgguagaauguuaaauauauuaaauagaagaagaagaaauuucgaucuuuuaaaacuugcuggagacguugagaguaacccagguccaagugcgggaaugauaauuaugcugauacccacaguaauggcuuuccauuuaacuacaagaaauggugaaccucauaugaucgucaguagacaagaaaaaggaaaaagucuacuauucaaaacagaagauggugucaacauguguacauugauggcaauggacuuaggcgaauugugugaagauacuauuacuuacaaauguccgcuacuaagacaaaaugaaccagaagauauugauugcugguguaacucaacaucaacauggguaacuuacggaaccuguacaacaaugggggaacauaggagagagaaaaggagcguugcgcucguuccacauguugguaugggauuagaaacaagaacagaaacauggaugagcucagaaggugcauggaaacacguucaacguauagaaacauggauucuaagacacccuggauucacuaugauggcugcaauacuagcauauacaauaggaacuacacacuuucaaagggcacuaauauucauauuacuaacagcuguaacaccaaguaugacaaugagauguauaggaaugaguaacagagauuuuguagaaggaguauccggcgguucauggguagauauaguacuagaacacggaucauguguaacgacaauggcgaaaaacaaaccgacauuagauuucgaauuaauaaaaacggaagcaaaacaaccagcaaccuuaaggaaguacuguauagaagcuaaacuaacaaacacgacaaccgaaucuagauguccuacacagggugaacccucuuugaaugaagaacaagauaaaagauuuguuuguaaacauucuaugguagauagagguugggguaacggauguggauuauuuggaaaaggaggaauaguaacaugcgcaauguucagauguaagaaaaauauggaagguaaaguaguacagccugagaaccuugaauacaccauaguuauuacaccacauucaggcgaagaacacgcagugggaaaugacacuggaaaacaugguaaagaaauuaaaauaacaccgcaaaguagcauaacagaagcugaacuaacaggauaugggacagucacgauggaguguagcccacgaacaggccuagauuuuaacgaaaugguacuucuacaaauggaaaauaaggcuugguuaguacauagacagugguuucuugaucuaccuuuaccauggcuaccuggugcagauacacaaggcucgaacuggauacaaaaagaaacucuagucacauuuaaaaauccacaugcaaagaaacaagacguagugguacuuggaucacaagaaggagcuaugcauacagcacuaacaggggcuacugaaauacaaaugaguagcgguaacuuguuauucacugggcauuuaaaauguagauuaagaauggacaaacuacaauuaaaaggaaugaguuacucaauguguacaggaaaauucaaaguaguuaaagaaauagcagaaacacaacacgguacgauaguaauuaggguacaauaugaaggggacggaucucccuguaaaauaccauuugaaauaauggauuuagagaaaagacacguucuaggaagguuaauaacuguaaacccaauaguaacagaaaaagauucaccuguaaacauagaagcagaaccaccauucggagacucauauauaauaauaggaguagaacccggacaauuaaaauugaacugguuuaagaaaggaucaagcauaggacaaauguuugaaacuacaaugagaggugcaaaaagaauggcaauauugggagauaccgcaugggacuuugguagcuuaggaggaguguuuaccagcauaggaaaagcauuacaccaaguauuuggggcuauuuacggagcagcauuuucgggaguuagcuggacuaugaaaauauuaauaggugugaucauaacauggauagguaugaauaguagaucuacaaguuuaucuguaacuuuagugcuaguagguauaguaacauuauaucuagguguaaugguacaagcauaa

SEQ ID NO: 2232 - RNA, 2043 nt, Artificial Sequence
  derived and/or modified CDS sequence (opt6) from DENV-2 CYD2-T__SSopt-prME(F108S)
augaaacgaaagaaaagcgcaggaaugauuauaaugcuaauacccacaguuauggcauuucaucuaacaacaaggaauggagaaccacacaugauaguaucaagacaagaaaaagguaaaaguuuacuuuuuaaaacagaagauggaguuaauauguguacacugauggccauggaucuaggugaacuaugugaagauacaauaacauauaaauguccuuugcuacgacaaaaugaaccagaagauauagauugcugguguaauagcacaucgacauggguaacauauggaacaugcacgaccaugggagaacauagacgagaaaaacgcagcguagcauuaguaccacauguaggaaugggacuagaaacaaggacagaaacauggaugaguagugaaggagcauggaaacauguacaaaggauagaaacauggauauuaaggcauccaggauuuacaaugauggcagcuauauuagcauauacuauagguacaacucauuuucaaagggcauuaauauuuauuuuauuaaccgcaguuacuccaucaaugaccaugagauguauaggaaugagcaauagagauuucguagaaggaguaucaggaggaucauggguagauauaguauuagaacauggaucauguguuaccacuauggcuaaaaacaaaccaacgcuagauuuugaauuaauuaaaacagaagcaaaacaaccagcaacguugagaaaauauugcauagaagcaaaauugacgaacaccacaaccgaaucaagauguccaacccaaggagaaccaagccuaaaugaagaacaagacaaaagauuuguaugcaaacacaguaugguagauagaggauggggaaauggauguggauugucaggaaaaggcggaauuguuaccugugcaauguucagguguaagaaaaacauggaagguaaaguuguucaaccagaaaaccucgaauacacuauaguaauaacuccucauucaggugaagaacaugcaguagguaacgauacggguaaacaugggaaagaaauaaaaauaacuccacagagcaguauaacggaagccgaauuaacgggauacggaacuguaacuauggaauguucaccaagaacaggauuagauuuuaaugaaaugguucuacuacaaauggaaaacaaggcuuggcuaguacacagacaaugguuuuuagaccuuccauuaccaugguugccuggagcagacacacaaggaagcaauuggauacaaaaagaaacucuaguaacauuuaaaaauccucaugcaaagaaacaagacguaguaguucuugguucucaagaaggugcaaugcauaccgcucuuacaggagcuacagaaauccaaaugucaaguggaaaucuauuauuuacaggacacuuaaaaugccgauuaagaauggacaaacuacagcuaaaaggaaugaguuauucaaugugcacaggcaaauuuaaaguuguaaaagaaauagcggaaacacaacacggaacaaucguaauuagaguacaauacgaaggagaugguucaccauguaaaauaccguucgaaaucauggaucuugagaaaagacauguacuaggacgacugauaacaguuaauccaauuguaacagaaaaagauucaccuguaaauauagaagcagaaccuccuuuuggagauucuuauauaauaaucggugucgaaccaggacaacuaaaacucaauugguuuaagaaaggcaguucaauaggacaaauguuugaaacaacaaugagaggagcaaaaagaauggcaauauuaggagauaccgcaugggauuuugguucauuaggagguguauuuacaucuauaggaaaagcauugcaccaaguauucggugcuauauacggagccgcauucucaggaguaucuuggacuaugaaaauacuaauaggagucauaauaacauggauaggaaugaacucaagauccacaucuuuaagcguaacucuaguauuaguaggaauaguaacacuauacuuaggagucaugguacaagcauaa

SEQ ID NO: 2233 - RNA, 2043 nt, Artificial Sequence
  derived and/or modified CDS sequence (opt6) from DENV-2 CYD2-T__SSopt-prME(M96H)
augaaacgaaaaaaaucagcuggaaugauaauuaugcuaauaccuacgguaauggcauuucacuuaacaacaaggaauggugaaccacauaugauaguaucaagacaagagaaaggaaaaagccucuuauuuaaaacagaagauggaguaaacauguguacucuaauggcaauggauuuaggcgaacuaugugaagauacuauaacauauaaauguccccucuuaagacaaaaugaaccagaagauauagauuguugguguaauucaacaagcacauggguaacauauggaacauguaccacaaugggagaacauagaagggaaaaacguucaguagcucuagucccacaugugggcaugggucuagaaacacgaacagaaacauggaugagcagugaaggagcauggaagcauguccaacgaauagaaacuuggauauugcgacauccaggcuucacuaugauggcugcuauauuagccuauacgauugggacaacgcauuuucaaagggcauuaauuuuuauuuuauuaacagccgugacaccgucaaugacaaugagaugcauagguaugucuaauagagauuuuguagaaggaguaucagguggaucauggguagauauaguacuagaacauggaucauguguuacuacaauggcaaaaaauaaaccaacacuugacuucgaauuaauaaaaacagaagcaaaacaaccagcaaccuuaagaaaauauuguauagaagcuaaacuaacaaauacaacaacagaauccagaugucccacacaaggagaacccaguuuaaaugaagaacaagacaaacgauucguauguaaacauucacauguggauagagguugggguaauggauguggauuauucggaaaaggaggaauaguaacaugcgcaauguuuagauguaaaaagaauauggaagguaaaguaguacaaccagaaaauuuagaauauacuauagucauaaccccacauaguggagaagaacaugcgguaggaaaugacacuggaaaacauggaaaagaaaucaaaauuacuccucaaucaucaauaacugaagcagaacuuacuggcuauggaacgguaacaauggaauguuccccaagaaccgguuuagacuuuaaugaaaugguauuauuacaaauggaaaauaaagcauggcucguacaucgacaaugguucuuggauuuaccauuaccuuggcuaccuggagccgauacacaaggaucaaauuggauacaaaaagaaacguuaguaaccuuuaaaaauccacaugcaaaaaaacaagacguaguuguacuaggcucucaagaaggugcaaugcacacagccuuaacaggagcaacagaaauacaaaugaguuccggaaauuuacuauucacaggacaucuaaaauguagauuaagaauggauaaacuacaauuaaaagguaugucauacaguauguguacagguaaauuuaaaguaguaaaagaaauagcugaaacacaacauggaacaauagugauaagaguucaauaugagggugacggcucgccauguaagauaccauuugaaauaauggaucuugaaaaaagacauguacuaggaagauuaauaacaguaaacccaauaguaaccgagaaagauucaccuguaaauauugaagccgaaccaccauuuggagacucuuauauuauaauagguguugaacccgggcaauuaaaauuaaauugguuuaaaaaaggaaguucaauaggucaaauguuugaaacaacaaugagaggcgcuaaaagaauggccauauuaggagacacagcaugggacuucggcucccuaggagggguauuuacuaguauagguaaagcguuacaccaaguuuucggcgcuauauauggagcagcauuuaguggcguaaguuggacaaugaaaauuuuaauagggguaauaauaacuuggauaggaaugaauucuagaucgacaagucuaaguguaaccuuaguccuggucgguauagugacuuuauaccuaggaguaaugguacaagcauaa

SEQ ID NO: 2234 - RNA, 2043 nt, Artificial Sequence
  derived and/or modified CDS sequence (opt6) from DENV-2 CYD2-T__SSopt-prME(S186F)
augaaacgaaagaaaagugcaggaaugauaaucauguuaauaccaacaguaauggccuuucaucuaacaacacgaaauggagaaccgcauaugauagucucaagacaagaaaaaggaaaaucacugcuauucaaaacagaggauggaguaaauauguguacauuaauggcuauggaucuaggugaacuaugugaagacacaauaacauacaaauguccacuauuaagacaaaaugaaccugaagacauagauugcuggugcaauaguaccucaacguggguaacauacggcacauguacaacaaugggugaacauagaagggaaaagcgguccguagcauuaguaccacauguaggaauggguuuagaaacaagaacagaaacauggaugagcucagaaggggcauggaaacauguacaaagaauagaaacuuggauucuucgacacccuggauuuacaaugauggcagcaauacuagcauauacaauaggaacaacacacuuccaaagagcauuaauauuuauuuuacucacagccguaacaccaaguaugaccaugagauguauaggaaugagcaauagagauuuuguggaagguguaucaggcggaucauggguagauauuguauuagaacauggaucauguguuaccacuauggccaaaaauaaacccacauuagacuuugaacuaauuaaaacugaagcaaaacaaccagcaacacuccgcaaauauuguauagaagccaaauuaacaaauacaacaacagagucgagaugcccuacacaaggagaaccaaguuuaaaugaagaacaagacaaaagauuuguguguaaacauucaauggucgacaggggauggggaaaugguuguggauuauuugguaaaggaggcauaguaacaugugcuauguuccgaugcaagaaaaacauggaaggaaaaguaguacagccagaaaauuuagaguacacaauaguaauaacaccacacucgggagaggaacaugcaguggguaaugauacaggaaaacaugggaaagaaauaaaaauuacaccacaaagcucaauaacagaagcagaauuaacuggauauggaacagucacgauggaauguuucccuagaacaggcuuagauuucaacgaaaugguacuuuuacaaauggaaaauaaagcauggcuuguacauagacaaugguuuuuggauuuaccauuaccaugguuaccuggugcugauacucaaggcucaaauuggauacaaaaagaaacgcuaguaacauucaaaaauccacacgcgaagaaacaagauguaguaguucuaggaucacaagaaggagcaaugcauacggcacuaacaggagcuacagaaauacaaaugucaaguggaaaccuauuauuuacaggacaccuaaaaugcagacuaagaauggauaaauuacaguuaaaaggaaugucauauagcauguguacagggaaauuuaaaguagugaaagaaauagcggaaacgcaacauggcacaauaguaauaagaguacaguaugaaggagauggaucucccugcaaaauacccuuugaaauaauggacuuagagaaaagacacguacuaggaagauuaaucacaguaaauccaauagucacagaaaaagacucuccaguaaacauagaagcugaaccacccuucggagauuccuacauaauaauaggagucgaaccaggacaauuaaaacuaaacugguucaagaaaggaucuucaauaggucaaauguucgaaacaacuaugaggggugcaaaacgaauggcaaucuuaggugauacagcuugggacuuugguaguuuagguggaguauuuacaagcauaggaaaagcccuacaccaaguauuuggcgcaauauacggagcagcauuuucaggaguaagcuggacaaugaaaauacuuauaggagugauaauuacauggauaggaaugaacucacgaucaacaucacuaagcguaacauuaguauuaguaggaauuguaacauuguauuuagguguaaugguacaagccuaa

SEQ ID NO: 2235 - RNA, 2043 nt, Artificial Sequence
  derived and/or modified CDS sequence (opt6) from DENV-2 CYD2-T__SSopt-prME(R188L)
augaaaagaaaaaaaucagccggaaugauaauaaugcugauaccaacaguaauggcauuucauuuaacaacaagaaacggagaaccccacaugauaguuaguagacaagaaaaagguaagucacugcuuuuuaaaacagaagacggagugaacaugugcacauuaauggcuauggaccuaggcgaauuaugugaagauacaauaacuuauaaaugcccauuacuaagacaaaaugaaccagaggauauagauuguugguguaauucaacaucaacuugggucacuuaugguacuugcaccaccaugggagaacaucgaagagaaaaacguagugucgcauuaguaccacacguaggaauggguuuagaaacacgaaccgaaacuuggaugucaagugaaggcgcauggaaacauguacaacguauagaaacuuggauacuaagacaucccggauuuacaaugauggcagcaauauuagcuuauacaaucggaaccacacacuuucaacgagcauugauauucauauuauuaacagcuguuacaccaagcaugacaaugagaugcauagguaugucgaauagagauuuuguugaaggaguuaguggaggaucuuggguggacauuguauuagaacaugguuccuguguaacaacaauggcuaaaaacaaaccaacauuagauuuugaauuaauaaaaacagaggcaaaacagccggcuacccuaagaaaauauuguauagaagcaaaacuaacaaacacaacgacagaaagucgaugucccacacaaggagaaccuagcuuaaaugaagagcaagauaaaagauuuguuuguaaacauaguaugguagauagaggauggggaaauggcuguggacuauuuggaaaaggaggaauagugacaugugcaauguuucgauguaaaaaaaacauggagggaaaaguaguacagccagaaaaucuggaauacacaauuguaauaacaccacacucaggagaagaacaugccguagguaacgauacaggaaaacauggaaaagaaauaaaaauaacaccacagaguucaauaacagaagcugaauuaacuggauaugggacaguaacaauggaguguaguccacuuacaggauuagauuuuaacgaaaugguacuucuacaaauggaaaacaaagcaugguuaguacauagacaaugguuuuuagauuuaccauuacccuggcuaccuggugcugauacacaaggaaguaacuggauacaaaaagaaacauuaguaacauucaaaaacccacaugcuaaaaaacaagauguaguaguauuaggaucacaggaaggagcaaugcacacagcauuaacuggggcaacagaaauacaaaugagcagcgggaacuuauuauucacaggacaccuaaaauguagacuuagaauggacaaauuacaauuaaagggaaugucauauaguaugugcacaggaaaauuuaaaguuguaaaagaaauugcagaaacacaacauggcacaauaguaauaagaguacaauaugaaggggauggaaguccaugcaaaauaccauucgaaauaauggauuuagaaaaaagacauguacuuggucgcuuaauaacaguaaacccuauagucacugaaaaagauucuccuguaaauauagaagcugaaccaccauucggagacaguuacauaauaauaggaguagaaccaggucaacuaaaauuaaauugguuuaaaaaaggaucaaguauaggacaaauguuugaaacaacaaugagaggggcaaagcgaauggcuauacuaggagauacagcaugggauuuuggaucccuagggggaguauuuaccagcauagggaaagcauuacaucaaguauucggagccaucuauggugcggcauuuucugguguuaguuggacaaugaaaauucucauaggaguaauaauaaccuggauaggaaugaacucaagauccacaucacugucaguaacacuugugcuuguuggaauaguaacacuauacuuaggagucaugguacaagcauaa

SEQ ID NO: 2236 - RNA, 2043 nt, Artificial Sequence
  derived and/or modified CDS sequence (opt6) from DENV-2 CYD2-T__SSopt-pr(D104A)MEdelstem_TM,(F108S)-JEV
augaaacgcaaaaaaucagcaggaaugauaauaauguugauuccaacuguuauggcuuuucaucuaaccacaaggaauggagaaccacauaugauaguuucucgacaagaaaaaggaaaaucacuccuuuuuaaaacagaagauggaguaaauaugugcacacuaauggcaauggaccuaggggaacuaugugaagauacaauaacuuauaaauguccauugcuaagacaaaacgaaccagaagauauagacuguuggugcaauucaacuaguacguggguaacuuaugguacaugcacaacaaugggagaacaucgcagagcaaaacgaucugucgcauuaguaccacauguagguaugggauuggaaacuagaacagaaacauggaugaguucggaaggugcauggaaacacguacaaagaauagaaaccuggauauuacgacauccuggauuuacaaugauggcagcaauacuagcuuacaccauaggaacaacacacuuucaaagagcacuaauauuuauauugcuaacagcagugacaccaagcaugacaaugagauguauuggaaugagcaacagagacuucguagaaggagugucagguggaucauggguggacauaguauuagagcaugguagcugcguaacaacaauggcaaaaaauaaaccaacccuagauuuugaacugauaaaaacagaagcaaagcaaccagcaacacuaagaaaauauuguauugaagcgaaauuaacaaacacuacaacagaaaguagauguccaacucaaggagaaccgucgcuaaacgaagaacaagauaaacguuucgugugcaaacacagcaugguugauaggggauggggaaauggaugcggacuaucaggaaaaggaggaauaguaaccugugcgauguuuagauguaaaaaaaauauggaaggaaaaguaguacaacccgaaaauuuagaguacacaauaguaauaaccccgcauucaggagaagaacaugcagugggcaaugacacagguaaacaugggaaagaaauuaaaauaacuccucaaagcucuauaacagaagcagaauuaacaggcuauggaaccguaacaauggaauguaguccaagaacugggcuagauuuuaaugaaaugguauuauuacaaauggaaaauaaagcaugguuaguacaucgacaaugguuuuuagauuuaccucuaccaugguuaccaggggcagauacacagggaucaaauuggauucaaaaagaaacacuuguaacuuucaaaaacccacaugcuaaaaaacaagacguuguaguucugggaagucaagaaggagcaaugcauacggcauugacaggagcaacagaaauacaaaugaguagcggaaaccuucucuuuacaggacauuuaaaaugccgauuaaggauggauaaauuacaauuaaaaggaaugagcuauaguauguguacaggaaaauuuaaaguaguaaaagaaauugcagaaacacaacacggaacaauaguaauaagaguacaauacgaaggggauggaaguccuuguaaaauaccauuugaaauaauggauuuagaaaaaagacacguuuuaggaagacuaaucacaguuaauccaauaguaacugaaaaagacagcccaguaaauauagaagccgaaccaccauuuggagauucauauauaauuauagggguagaaccuggacaauuaaaacuaaauugguuuaaaaaaggaucuacgcuaggaaaagcauuuagcacuacucuaaaaggagcucaaaggcuagcagcuuuaggagauacagcaugggauuuugguucaauaggugggguuuucaauucaauaggaagagcgguacaccaaguauucggaggagcauuccgaacauuauucggcggaaugagcuggauaacacaaggacucaugggagcauuauuauuguggaugggaguaaaugcaagggacagaagcauagcacuagcauuucuugcaaccggugguguauuaguauuccuagcuacaaauguacaugcuuaa

SEQ ID NO: 2237 - RNA, 2043 nt, Artificial Sequence
  derived and/or modified CDS sequence (opt6) from DENV-2 CYD2-T__SSopt-prMEdelstem_TM,(H261N)-JEV
augaaacgaaaaaaaucagccggaaugauaauaauguuaauaccaacagucauggcauuucaccuaacaacgagaaauggagaaccucauaugauaguaucacgccaagaaaaaggaaaaagucuauuauuuaaaacugaagaugguguaaacaugugcacauuaauggcaauggacuuaggagaauuaugugaagacacaauaacauauaaauguccuuuauuacgucaaaaugaaccugaagacaucgacuguuggugcaauaguacaagcacauggguaacauaugggacauguacuaccaugggagaacauagaagagaaaaaaggaguguagcauuaguaccacauguagguaugggucuugaaacaagaacagagacauggaugaguucagaaggagcauggaaacauguacaaagaauagaaacguggauacuuagacauccuggcuuuacuaugauggcagcaauauuagcuuauacuaucggaacuacucauuuucaaagagcacuaaucuucauauuacucacagcaguaacaccaagcaugacaaugagauguauaggaaugaguaaccgagauuuuguagaaggaguaucaggagggucauggguugauauaguguuagaacauggaucauguguuacaacuauggcaaaaaauaaaccaacacuugacuuugaacuaauaaaaacagaggcaaaacaaccagcaacauuaaggaaauacugcauagaagcaaaacuaacaaauacuacaacagagagcagauguccuacacaaggagaaccgucauuaaaugaggaacaagauaaaagauuuguuuguaaacauagcaugguagacagaggauggggaaacggauguggauuauucggaaaaggaggaauaguaacgugugcaauguuucgcuguaaaaaaaauauggaaggcaagguaguacaaccagaaaauuuagaauauacuaucguuauaacaccccauucaggugaagagcaugcugugggaaacgacacagguaaacaugguaaagaaauaaaaauaacaccacaaaguagcauaacagaagcagaacuaacuggauauggaacuguaacaauggaauguucaccacguacuggcuuagauuuuaaugaaaugguauuauuacaaauggaaaauaaggcaugguuaguacauagacaaugguuucuagaucuaccacuuccauggcuaccaggagcagauacacagggaucuaauuggauucaaaaagaaacuuuaguuaccuuuaaaaacccucaugcuaaaaaacaagauguuguaguuuugggaagucaagaaggagccaugaauacagcacucacaggcgcaacagaaauucaaaugucuucuggaaaccuauuauucacaggacaucuaaaauguagauuaagaauggacaaauuacaauugaaggguaugucuuauagcaugugcacaggaaaauuuaaaguagugaaagaaauagcugaaacucaacacgguacaauuguaauaaggguacaauaugaaggagacgguucaccuugcaaaauaccauuugaaauaauggacuuagaaaaacgacacguauuaggaagacuuauaacuguaaauccaauagugacugaaaaagauucaccaguaaauauagaagcugaaccaccauuuggagauucauacauaauaauaggaguagaaccgggacaacuaaaauuaaacugguucaaaaaaggaagcacacuagguaaagcauucucaacaacucuaaaaggagcacaaagauuagccgcauuaggagauacagcaugggauuucgguucaauuggagggguauuuaauucuauaggaagagcaguccaucaaguauuugguggagcauuuagaacacuauuuggcggaaugucauggauuacucaaggauuaaugggagcacuuuuauuauggaugggaguaaacgccagagauagaucaauagcgcuugcuuucuuagcaaccgguggaguauugguauuuuuagcaacaaacguucacgcauaa

SEQ ID NO: 2238 - RNA, 2043 nt, Artificial Sequence
  derived and/or modified CDS sequence (opt6) from DENV-2 CYD2-T__SSopt-prMEdelstem_TM,(R188L,A267T)-JEV
augaaaagaaagaaaucagcaggaaugauuauaaugcuaauacccacaguuauggcauuucaucuaacaacacgaaauggagaaccccauaugauaguaagcagacaagaaaaaggaaaaaguuuauuauuuaaaacagaagaugguguaaacauguguacccuaauggcaauggauuuaggugaauuaugugaagauacaauaacauauaaaugcccacuacuaagacaaaacgaaccagaagauauagauugcuggugcaauagcacaagcacauggguuacauauggaacauguaccacaaugggagaacacagacgagagaaacgaucaguagcucuaguaccucauguaggaaugggacuagaaacaagaacagaaacauggaugaguucagaaggagcauggaaacacguccaaagaauugaaacguggauacuaagacacccaggguucacaaugauggcagcuauacuagcauauacaauaggaacaacucauuuccaaagggcacugauauuuauauuauuaacagcaguaacaccaaguaugacaaugcgaugcauaggcaugagcaauagagauuuuguagaaggcgucucugguggaagcuggguugacauaguauuagaacauggaagcuguguuacuacaauggcgaaaaacaaaccuacuuuggacuuugaacuuauuaaaacagaagcaaaacaaccggcaacauuaagaaaauacuguauagaagcaaaacugacaaacacaaccacagaauccagauguccaacccagggagaaccaaguuuaaaugaagaacaagacaaaagguuuguaugcaaacacucaaugguagacagaggcuggggaaauggcuguggucuuuuugguaaaggaggaauuguuacaugugcaauguuuagauguaagaaaaacauggaagguaaaguuguacaaccugaaaauuuagaauauaccauuguaauaaccccacauuccggagaagaacaugcaguaggaaacgauacuggaaaacacggaaaagaaauuaaaauuacaccacagagcucaauuacugaagcugaauuaacaggcuacggaaccguaacaauggaauguaguccauuaacaggacuugauuuuaaugaaaugguauuacuacaaauggaaaacaaagcauggcugguacacagacaaugguuccuugaucuaccacuuccauggcucccaggagcagauacgcaagguaguaauuggauacaaaaagaaacucuagugacuuucaaaaacccgcacgcuaagaaacaggauguaguaguuuugggaucacaagaaggagcaaugcacacugcauuaacgggaacaacugaaauacaaaugaguuccgguaauuugcuauuuacaggacaccuaaaauguagacuuaggauggacaaauuacaguuaaaaggaaugaguuauucuauguguacaggaaaauuuaaaguagugaaagaaaucgcagaaacacaacauggaacaauuguaauuagaguacaauaugaaggagauggaucaccauguaaaaucccauuugaaauaauggaucuagagaaaaggcauguauuagguagacuaauaacaguaaaucccauagucacggaaaaagauuccccaguaaacauagaagcagaaccaccuuuuggagauaguuauaucauuauaggaguagaaccagggcaauuaaaacuaaauugguuuaagaaaggaaguacucuaggaaaagcauuuaguacuacacuuaaaggagcgcaaagacuagcagcacuaggagacacggccugggacuuuggaucaauaggcggcguauuuaacucaaucggcagagcaguacaccaaguauucggaggagcauuuagaacauuguuuggaggaaugucauggauaacacaaggauuaaugggagcauuauuauuauggaugggaguaaaugcaagagauagaagcauugcauuagcauuuuuagcuacaggaggaguauuaguauucuuagccacaaauguacacgcauaa

SEQ ID NO: 2239 - RNA, 297 nt, Artificial Sequence
  derived and/or modified CDS sequence (opt6) from DENV-4 Consensus__C
augaaccaaagaaaaaaaguaguaagaccaccauuuaacaugcuaaaaagagaaagaaacagaguaagcacaccacaaggacuaguaaaaagauucagcacaggauuauucucaggaaaaggaccacuaagaaugguacuagcauucauaacauuccuaagaguacuaagcauaccaccaacagcaggaauacuaaaaagauggggacaacuaaaaaaaaacaaagcaauaaaaauacuaauaggauucagaaaagaaauaggaagaaugcuaaauauauuaaacggacgaaaaaga

SEQ ID NO: 2240 - RNA, 339 nt, Artificial Sequence
  derived and/or modified CDS sequence (opt6) from DENV-4 Consensus__C-SSc
augaaccaaagaaaaaaaguaguaagaccaccauucaacaugcuaaaaagagaaagaaacagaguaagcacaccacaaggacuaguaaaaagauucagcacaggacuauucucaggaaaaggaccacuaagaaugguacuagcauucauaacauuccuaagaguacuaagcauaccaccaacagcaggaauacuaaaaagauggggacaacuaaaaaaaaacaaagcaauaaaaauacuaauaggauucagaaaagaaauaggaagaaugcuaaacauacuaaacggaagaaaacgaucaacaauaacacuacuaugccuaauaccaacaguaauggca

SEQ ID NO: 2241 - RNA, 273 nt, Artificial Sequence
  derived and/or modified CDS sequence (opt6) from DENV-4 Consensus__pr
uuucacuuaagcacaagagacggagaaccauuaaugauaguagcaaaacaugaaagaggaagaccauuacuauuuaaaacaacagaaggaauaaacaaaugcacacuaauagcaauggacuuaggagaaaugugugaagacacaguaacauauaaauguccauuacuaguaaacacagaaccagaagauauagacugcuggugcaaucuaacaagcacauggguaauguauggaacaugcacacaaucaggagaaagaagaagagaaaaaaga

SEQ ID NO: 2242 - RNA, 225 nt, Artificial Sequence
  derived and/or modified CDS sequence (opt6) from DENV-4 Consensus__M
aguguagcauuaacaccacauaguggaaugggauuagaaacaagagcagaaacauggaugaguagugaaggagcauggaaacaugcacaaagaguagaaaguuggauauuaagaaauccaggauuugcauuauuagcaggauuuauggcauauaugauaggacaaacaggaauacaaagaacaguauuuuuuguauuaaugauguuaguagcaccaaguuaugga

SEQ ID NO: 2243 - RNA, 498 nt, Artificial Sequence
  derived and/or modified CDS sequence (opt6) from DENV-4 Consensus__prM
uuucauuuaaguacaagagauggagaaccauuaaugauaguagcaaaacaugaaagaggaagaccauuauuauuuaaaacgacagaaggaauaaauaaauguacauuaauagcaauggacuuaggagaaaugugugaagauacaguaacauauaaauguccauuauuaguaaauacagaaccagaagauauagauugcugguguaauuuaacaaguacauggguaauguauggaacauguacacaaucaggagaaagaagaagagaaaaaagaaguguggccuuaacaccacacucaggaaugggauuagaaacaagagcagaaacauggaugagcucagaaggagcauggaaacaugcacagagaguagaaaguuggauauuaagaaauccaggauuugcauuauuagcaggauuuauggcauacaugauaggacaaacaggaauacaaagaacaguauucuuuguauuaaugauguuaguagcaccaaguuaugga

SEQ ID NO: 2244 - RNA, 1485 nt, Artificial Sequence
  derived and/or modified CDS sequence (opt6) from DENV-4 Consensus__E
augagaugugugggaguaggaaacagagacuuuguagaaggcguaaguggcggagcauggguggauuuaguauuagaacauggaggaugcguaacaacuauggcgcaaggaaaaccaacacuugauuuugaacuuacaaaaacaacagcuaaagaaguagccuuauuaagaacuuauuguauugaagcaaguauaucaaacauaacaacagcaacuagauguccaacacaaggagaaccauauuuaaaagaagaacaagaccaacaauacauaugucgaagagauguaguagauagaggaugggguaauggauguggauuauuuggaaaaggagguguaguuacaugugcaaaauuuagcugcaguggaaaaauaacaggaaauuuagugcaaauagaaaauuuggaauauacagucguaguaacagugcauaauggagauacacaugcaguaggaaaugauacaaguaaucacggaguuacggcgacgauaacaccaagaucaccuagcguagaaguuaaauuaccagauuauggagaauuaacgcuagauugugaaccuagaucgggcauagacuuuaaugaaaugauauuaaugaaaaugaaaaagaaaacaugguuaguacacaaacaaugguuucuagacuuaccauuaccauggacagcaggagcagacacgucagaaguacauuggaacuauaaagaaagaaugguaacauuuaaaguaccacaugcuaaaagacaagacguaacaguacucggaagccaagaaggagcaaugcacagcgcauuagcgggagcaacagaaguagauaguggagauggaaaccauauguuugcgggacacuuaaaauguaaaguaagaauggaaaaacuuagaauuaaaggaaugagcuauacuauguguucaggaaaauuuaguauagacaaagaaauggcggagacacagcacggaacaacaguagugaaaguaaaauacgaaggagcaggagcaccguguaaagugccaauagaaauaagagauguuaauaaagagaaaguaguaggaagagugauaaguaguacaccacuugcugaaaacacaaacaguguaacuaauauugaauuagaaccgccauuuggugacucauacauagugauuggaguaggaaauucagcauuaacacugcacugguuuagaaagggaucaaguauuggcaaaauguuugaaagcacauauagaggagcaaaaagaauggcaauauuaggagaaacagcaugggacuuuggaaguguaggaggauuauucacaagucuagggaaagccguacaccaaguauuuggaaguguauauacaacaauguuuggagggguaucauggaugauaagaauuuuaauaggauuuuugguacuauggauaggaacaaauaguagaaauacaaguauggcaaugacuugcauagcaguaggaggaauaacauuauucuugggauucacaguacaagca

SEQ ID NO: 2245 - RNA, 1983 nt, Artificial Sequence
  derived and/or modified CDS sequence (opt6) from DENV-4 Consensus__prME
uuccauuuaucuacccgugacggugaaccacuaaugauuguagcaaaacaugaaagaggaagaccauuacuauuuaaaacgacagaggguauaaauaaguguacauuaauugcaauggauuuaggagaaaugugugaagauaccguaacauauaaauguccauuauuaguaaauacugaaccagaagauaucgacuguugguguaaucuaacaaguacauggguaauguauggaacauguacacaaaguggagaaagaaggagagagaaaagaucaguagcauuaacuccccacucuggaaugggauuagaaaccagagcagaaacuuggaugaguagugaaggagcauggaaacaugcacagcguguagaaucauggauauuaagaaauccaggauuugcucuacuugcaggauuuauggcauauaugauaggacaaacaggaauacagcgaacaguauucuuuguauugaugauguuaguugcaccuaguuauggaaugagaugcguuggaguaggaaauagagauuuuguagaaggaguaagugguggagcauggguagaucuaguauuagaacauggaggauguguuacuacaauggcacaaggaaaaccaacauuagauuuugaacuaacaaaaacgacggcgaaagaaguagcacuacuaagaaccuauugcauagaggcuucaauaucaaauauaacuacagcgacaagaugcccaacacaaggagaaccauaucuaaaagaagaacaagaucaacaauauauuuguagacgagauguaguggauagaggguggggaaauggauguggauuguuuggaaaaggaggaguuguaacaugugcaaaauucucaugcucaggaaaaauuacuggcaauuuaguacagauagaaaauuuagaguauacaguaguaguaacaguacauaauggagauacacacgcuguaggaaaugacacaagcaaucacggagucacggcaacuaucacaccaaggagcccuucuguagagguuaagcuaccagacuauggagaauuaacacuagacugugagccuagaagcggcauagauuucaaugaaaugauacuuaugaaaaugaaaaagaaaacaugguuggugcauaaacagugguuucuggaucuaccauuaccauggacagcaggcgcugacacaucagaaguacauuggaauuauaaagaacgaaugguaacguucaaaguaccacaugcaaaacggcaagaugugacaguacuaggaucacaagaaggagcaaugcauucagcgcuagcuggagcaacagaaguugauaguggagauggaaaucauauguuugcaggacaccuaaaaugcaaaguaagaauggaaaaguuaagaauaaaggggaugaguuauacgaugugcucaggaaaauucaguaucgauaaagaaauggcagaaacucaacauggaacaacaguaguaaaaguuaaauaugaaggugccggugcuccauguaaagucccaauugagauucgagauguaaauaaagaaaaagugguaggaagaguaauaaguucaacaccauuagcagagaauacuaauaguguaacaaauauagaauuagaaccgccuuuuggagauucauauauaguaauagguguaggaaauucagcauuaacuuuacacugguuuagaaaaggaagcucaauuggaaaaauguuugaaucuacguauaggggagcuaaacgaauggcaauauugggagaaaccgcaugggauuuuggaagcguaggcggguuauuuacgagccugggaaaagcaguacaccaaguauucgguaguguauacacaacaauguucggaggagugucauggaugauacgaauuuugauaggauuucuaguauuauggauaggaacuaauagcagaaauacaaguauggcaaugacauguauugcaguugggggaauaacauuauuuuuaggauucacgguacaagca

SEQ ID NO: 2246 - RNA, 2025 nt, Artificial Sequence
  derived and/or modified CDS sequence (opt6) from DENV-4 Consensus__SSc-prME
ucaacaauuaccuuauuaugucuaauaccaacaguaauggcauuucauuuaucaacuagagacggugaaccauuaaugauaguugcaaaacacgaaagagggagaccauugcuuuuuaaaacaacagaagguauaaacaaaugcacauuaauagcaauggacuuaggugaaaugugcgaagauacaguaacuuauaaaugcccauuauuaguaaauacugaaccggaagauauagacugcuggugcaauuuaacaagcaccuggguaauguacggaacuugcacucaaucaggugaaagaagaagagagaaaaggucaguugcauugacuccucauucaggaaugggacuagaaacaagagcugaaaccuggaugagcucagaaggagcuuggaaacacgcgcaaagaguugaaaguuggauacuaagaaacccaggcuuugcauuauuagcuggauuuauggcuuauaugauaggacaaacaggaauacaaagaacaguuuucuuuguauuaaugaugcucguugcaccaaguuacggaaugagguguguuggcguagguaauagagauuuuguagaaggaguaucuggaggagcauggguagauuuaguauuagaacaugguggcuguguaacaacaauggcacaaggaaaaccaacguuagacuuugaauuaacaaaaacuacagcuaaagaaguagcacuuuugagaacauauuguauagaagcaaguauaagcaauauaacuacggcgacaagaugccccacacaaggugaaccauaccugaaagaagaacaagaucaacaauauauuugcagacgagacguagucgaucgaggauggggaaaugguugcggauuauuuggaaaagggggaguaguaacaugcgcaaaauuuucaugcucagguaaaauaacaggaaauuuaguacagauagaaaacuuagaauauacagugguuguaacaguacacaauggggauacacaugcaguaggaaaugacacuucaaaucauggaguaacagcaacaauaacaccaagaucuccaagcguagagguaaaauuaccagauuauggugaacuuacuuuggauugugaacccagaaguggaauagacuucaaugaaaugauauuaaugaaaaugaaaaagaaaacauggcuuguacauaaacaaugguuucuugaccuacccuugccauggacugcgggagcagauacuagcgaaguacauuggaauuauaaagaaagaauggucaccuuuaaaguaccacaugcaaaaagacaagacguuacgguacuaggaagccaagaaggagcaaugcauuccgcccucgcaggcgcaacugaaguagauucaggcgauggaaaucauauguuugcgggucauuuaaaauguaaaguaaggauggagaaauuaagaauaaaaggaaugagcuauacaauguguaguggaaaauuuucaauagauaaagaaauggcagaaacucaacaugguacaacaguaguuaaaguuaaguaugaaggagcaggagccccauguaaagugccaauagaaauacgagauguaaauaaggaaaaaguuguuggaagaguuauaucaucaacaccauuagcagaaaacacaaauucaguaacuaauauagaauuagaaccucccuuuggagauucauauauagucauaggagugggaaacucagcauuaacacuucacugguuuagaaaaggaucaucaauuggaaaaauguuugaaucuacauauagaggugcgaaaagaauggcaauauuaggagaaacagcaugggauuuuggaagcguaggaggguuauucacaagccuuggaaaggcaguucaccaaguauucggaagcgucuauacgacaauguuuggaggaguaucauggaugaucagaauauuaauaggauuccuaguguuauggauaggaacuaacucaagaaacacaagcauggcaaugaccuguauagcaguuggaggaauaacguuauuucuaggauuuacaguucaagca

SEQ ID NO: 2247 - RNA, 2322 nt, Artificial Sequence
  derived and/or modified CDS sequence (opt6) from DENV-4 Consensus__C-prME
augaaucaacgaaagaaaguagugaggccgccauuuaauauguuaaaaagggaacgaaaucgaguuucaacaccacaaggauuaguaaaaagguucucaacaggccuauucaguggaaaaggaccgcuuagaaugguucuagcauuuauaacauuuuuaaggguauugucaaucccacccacugcgggaaucuuaaaaagauggggacaauuaaagaaaaacaaagcuaucaaaauauuaauaggauuuagaaaagaaauugggcgaaugcuuaauauauuaaaugggagaaaaaggucaacuauaacauuauuaugucuaauacccacaguaauggcauuccacuuaucaaccagagauggugaacccuuaaugauuguggcaaaacaugagaggggaagaccauuauuauuuaaaacuacugaaggaauuaacaaauguacauuaauagcuauggacuuaggcgaaaugugugaagacacaguuacauauaaauguccguuauuaguaaauacagagccagaagacauagauugcugguguaaucucacaagcacguggguaauguaugguacauguacucaaucaggcgaaagaagaagagagaaaagaucgguugcacugacuccgcacuccggaaugggauuagaaacaagagcugaaacguggaugucgucggaaggggcauggaaacaugcucaaagaguagaaucuuggauauuacggaauccaggcuuugcacuccuagcgggauuuauggcuuauaugauaggacaaacggggauacaacgaacaguauuuuucguccuaaugaugcuagucgcuccaucauaugguaugagauguguuggaguaggaaaccgagacuuugucgaaggugucucagggggagcuuggguagauuuagugcuagaacaugggggauguguaacaacaauggcucaagguaaaccuacuuuagacuuugaacuuacuaaaacaaccgcaaaagaaguagcuuuauuaagaacauauugcauagaagcaucaauaucaaauauuacaacggcaaccagauguccaacacaaggagaacccuauuuaaaagaagaacaggaucagcaauauauuugcagaagagauguaguagaucgagguuggggaaacgggugcggauuauuuggaaaagggggcguaguaacaugcgcuaaauucucuugcucuggaaaaauuacaggaaacuuaguccaaauagaaaacuuagaauauacaguaguaguuacuguacauaauggagauacccacgccgucggaaaugauacuucuaaccauggagucacagcaacaauaacaccaaggucaccaucaguugaaguaaaacuaccugauuauggagaauuaacuuuagauugugaaccaagaucagggauagauuuuaaugaaaugauacuaaugaaaaugaagaagaaaacaugguuaguucauaaacaaugguuuuuagaucuaccauuacccuggacggcaggagccgauaccucagaaguacacuggaauuauaaagaacguaugguaacuuucaaagugccucacgccaaaagacaagauguaacaguacuaggcagccaagaaggugcaaugcauagugcgcuagcaggagcaacagaaguagauagcggggacggcaaucauauguuugcaggacacuuaaaaugcaaaguaagaauggaaaaauuaagaauuaaaggaauguccuauacaauguguaguggaaaauuuucaauugauaaagaaauggcagaaacgcaacacggaaccacaguaguaaaaguaaaauaugaaggagcuggugcaccuugcaaaguaccaauagaaauaagggauguaaauaaagaaaaaguagucggaagaguuauaagcucuacaccauuagccgaaaacacaaauagcguaacgaauauagaauuagaaccaccauuuggagauucauacauugucauaggaguaggcaauuccgcauuaacacuacacugguucaggaaagguaguucaauaggaaaaauguuugaaaguacauaccgaggagcaaaaagaauggcaauauuaggugaaacagcuugggacuuuggaucaguaggagguuuauuuacaagccugggaaaggcaguacaucaaguuuucggaucaguguauacaacaauguuuggagguguaucguggaugauaaggauacugauaggauucuuaguauuauggauaggaaccaacaguagaaauacaucaauggcuaugacaugcauagcaguaggaggaauaacauuguuuuugggauuuacaguacaagca

SEQ ID NO: 2248 - RNA, 45 nt, Artificial Sequence
  derived and/or modified CDS sequence (opt6) from DENV-4 Consensus__SSc
auguccacaaucacacuccuaugccuaaucccaaccguaauggca

SEQ ID NO: 2249 - RNA, 57 nt, Artificial Sequence
  derived and/or modified CDS sequence (opt6) from DENV-4 Consensus__SSopt
augaaaagaaaaaaaagcacaauaacacuacuaugccuaauaccaacaguaauggca

SEQ ID NO: 2250 - RNA, 57 nt, Artificial Sequence
  derived and/or modified CDS sequence (opt6) from DENV-4 Consensus__SSm
augauacaaagaacaguauuuuucguacuaaugauguuaguagcaccaucauacgga

SEQ ID NO: 2251 - RNA, 1488 nt, Artificial Sequence
  derived and/or modified CDS sequence (opt6) from DENV-4 Consensus__E
augagauguguaggaguaggaaacagagacuuuguagagggaguaagugguggagcauggguggauuuggucuuagaacauggagguugcguaacaacaauggcacaaggaaaaccaacacuagacuuugaauuaacaaaaacaacagcuaaagaaguagcauuauuaagaacuuacuguaucgaagcaaguauaaguaauauaacaacagcaacaagaugcccaacccaaggggaaccuuaucuaaaagaagaacaagaucaacaauauauauguagacgagauguaguagacagaggauggggaaauggauguggauuauuugggaaaggaggaguaguaacgugugcuaaauucagcuguagcggaaaaauaacuggaaacuuaguucaaauagaaaaccuagaauacacaguaguaguaacaguacauaacggcgacacacaugcaguaggaaacgauacgaguaaccacgguguaacagcuacuauaacuccgagaaguccaagcguggaaguaaaauuaccugauuauggagaacuaacauuagauugcgaaccaagaucaggaauagauuuuaaugaaaugauacuaaugaaaaugaaaaagaaaaccuggcuaguucauaaacaaugguuccucgaucuuccacuuccauggacagcaggagcagauacaucagaaguccauuggaauuauaaagaaagaaugguuacuuucaaagugccacaugcaaaaagacaagauguuacaguauuaggaucgcaagaaggagcaaugcauagugcucuagcaggagcuacugaaguagauaguggagauggaaaucauauguuugcugggcacuuaaaauguaaaguaagaauggaaaaauuacgaauaaaaggaaugaguuauacaaugugcaguggcaaauuuaguauagauaaagaaauggcagaaacccaacacggaacaacaguaguuaaaguaaaauaugaaggagcgggagcaccuuguaaaguaccaauagagauaagagacguaaauaaagagaaaguagucggacguguaauaaguaguaccccauuggcagaaaacacaaauaguguuacaaacauagaguuagaaccaccauuuggagauaguuauauaguaauuggcguaggaaauagcgcacuaacauuacacugguuuagaaaaggaagcaguauagggaaaauguuugagagcacauauagaggugcuaaaagaauggcaauauuaggugaaacggcaugggauuucgguagugugggaggacuauuuacaucauuaggaaaagcaguacaucaaguauuuggaagcguauacacgacaauguucggaggaguaagcuggaugauaagaauauuaauaggcuuuuuaguguuauggauaggaacaaauaguagaaauacaaguauggcaaugacauguauagcagugggaggaauaacuuuauuucuaggauucacaguacaagcauaa

SEQ ID NO: 2252 - RNA, 1182 nt, Artificial Sequence
  derived and/or modified CDS sequence (opt6) from DENV-4 Consensus__EdelTM-variant (aa1-394)
augagauguguaggaguaggaaaccgugauuuuguagaaggaguaagcggaggggcuuggguagauuuaguguuagaacauggagguuguguaacaacaauggcacaaggaaaaccaacauuagauuuugaauuaacaaaaacaacagcaaaagaaguggcacuacuaagaacauauuguauagaagcaaguauaaguaauauaacaacagcgacacgaugcccgacacaaggagaaccauaccuaaaggaagaacaagaucaacaauauauauguagaagggaugugguagacaggggguggggaaauggauguggucuuuuuggaaaaggagggguaguaacaugugcaaaauuuagcuguucaggaaaaauaacaggaaaccuaguacaaauagaaaaucuagaauauacaguaguaguuacaguacauaauggagauacucacgcaguaggaaaugauacaucaaaccauggaguaacagcaacaauaacaccaagaaguccaagcguugaaguaaaauuaccagauuacggagaauuaacauuagacugugaaccaagaaguggaauagacuuuaaugaaaugauauuaaugaaaaugaaaaagaaaacauggcuaguacacaaacaaugguuuuuggauuuaccauuaccauggacagcaggggcagauacaagugaaguucacuggaauuauaaagaaagaaugguaacauuuaaaguaccacaugcgaaaagacaagaugugacagucuuagggagccaagaaggagcaaugcauagcgcacuagcaggagcaacagaaguagauucaggagauggaaaccauauguuugcaggacaccuaaaaugcaaaguaagaauggaaaaacuaagaauaaaaggaaugaguuauacaauguguagcggaaaauuuaguauagacaaagaaauggcagaaacucaacaugggacaacgguagugaaaguaaaauaugaaggagcaggagcaccaugcaaaguaccaauagaaauaagagauguaaauaaagaaaaaguaguaggucgaguaauuaguaguacaccacuagcagaaaacacaaauagcguaacaaauaucgaauuggaaccaccauuuggagauaguuauauaguaauaggaguaggaaauagcgcacuaacacuacauugguuuagaaaa

SEQ ID NO: 2253 - RNA, 1272 nt, Artificial Sequence
  derived and/or modified CDS sequence (opt6) from DENV-4 Consensus__EdelTM-variant (aa1-424)
augagaugcguaggagucggaaauagggacuuuguagaaggaguaucaggaggagcauggguagauuuaguauuagaacauggcgguuguguaacaacaauggcacaaggaaaaccaacauuagauuucgaauuaacaaagacaacugcuaaagaaguagcuuuacuaagaacauauuguauagaagcgucaauaaguaauauaacuacagcgacuagauguccgacacaaggagaaccauauuuaaaagaggaacaagaucaacaauauauauguagaagagauguaguagauagaggauggggaaacggauguggauuauucggaaaaggaggaguggucacaugugcaaaauuuagcugcaguggaaaaauaacuggaaauuuagugcaaauagaaaauuuagaauacacagugguaguaacaguucauaauggagacacacaugcagucggaaacgacacaagcaaucauggaguaacagcgacaauaacaccaagaaguccgagcguagaaguaaaauuaccagauuauggggaacuaacacuagauugugaaccaagaucgggaauagauuuuaaugaaaugauauuaaugaaaaugaaaaagaaaacaugguuaguucauaaacaaugguuucuagacuuaccauuaccauggacagcuggagcagauacaagugaaguacauuggaacuauaaagaaagaaugguuacauucaaaguaccgcaugcaaaaagacaagacguaacaguauuagggagucaagaaggagcaaugcauagugcauuagcgggugcaacagaaguagauagcggagacggaaaucauauguuugcaggacauuuaaaauguaaaguacgaauggaaaaauuaagaauaaaagggaugaguuauacgauguguucgggaaaauuuagcauugauaaagaaauggcagaaacacaacauggaacaacaguaguaaaaguaaaauaugagggagcaggagcucccuguaaaguaccaauagaaauaagagauguaaauaaagagaaaguaguaggaagaguaauaaguucaaccccauuggcagaaaauacaaauaguguaacuaauauagaauuagaaccaccuuuuggagacaguuauauaguuauaggaguaggaaauucagcguuaacauuacauugguucagaaaagguaguucaauaggaaaaauguuugaaaguacguauaggggagcaaaaagaauggcaauauugggggaaacagcgugggacuuuggaagu

SEQ ID NO: 2254 - RNA, 1266 nt, Artificial Sequence
  derived and/or modified CDS sequence (opt6) from DENV-4 Consensus__EdelTM-variant (aa1-421)
augagauguguaggaguaggaaauagagauuuuguagaaggaguaaguggaggagcauggguagaccuaguacuagaacauggaggauguguaacaacaauggcucaaggaaaaccaacguuagauuuugaauuaacuaaaacaacagcaaaagaaguagcacuauuaagaacuuacugcauagaagcaucaauaagcaauauaacuacagcaacaagauguccaacacaaggagaaccauauuuaaaggaagaacaagaucaacaauauauaugcagaagagauguaguagacagagguuggggaaacggauguggauuguucggaaaaggaggaguaguuacaugugcaaaauuuaguuguagcggcaaaauuacaggaaauuuaguacaaauagaaaaucuagaguauacaguaguaguaacaguacauaauggagauacacaugcaguaggaaaugauacaaguaaucauggagucacggcuacaauaacgccaagaagcccaaguguagagguaaaacuaccagauuacggagaauuaacauuagauugugaaccuagaaguggaauugauuuuaaugaaaugauauugaugaaaaugaaaaagaaaacaugguuaguucauaaacaaugguuuuuagaucuuccucuaccauggacagcaggagcagauacaucagaaguucauuggaacuauaaagagaggaugguaacauucaaaguaccacaugccaaaagacaagauguaacaguacuagguagucaagaaggagcaaugcauagugcauuagcaggggcaacagaaguagauaguggagauggaaaucauauguuugcaggacaucuaaaaugcaaaguucgaauggaaaaacuaagaauaaaaggaaugagcuauacaaugugcaguggcaaauuuucaauagacaaagaaauggcagaaacacaacauggaacaacagucguaaaaguaaaauacgaaggcgcaggagcaccuuguaaagucccaauagaaauaagagacguaaauaaagaaaaaguuguaggaagaguaauaaguagcacaccauuagcagaaaacacaaauaguguaacaaauauagaacuagaacccccauucggagauaguuauauaguaauuggaguaggaaauucagcucuaacauuacauugguucagaaaagguaguagcauaggaaaaauguuugaaaguacguacagaggggcaaaaaggauggcaauauuaggagaaacagcaugggauuaa

SEQ ID NO: 2255 - RNA, 2031 nt, Artificial Sequence
  derived and/or modified CDS sequence (opt6) from DENV-4 Consensus__SSc-prME
augucaacaauuacuuuacuaugccuuauaccaaccguuauggcauuucaucuaagcacuagagauggugaaccauuaaugauaguagcaaaacaugaaagaggaagaccauuacuauuuaaaacuacagaaggaauaaacaaauguacauuaauagcaauggaucugggagaaaugugcgaagauacuguaacuuauaaauguccauuacuuguuaauacagaaccagaagacauagauuguugguguaaucuaacaagcacaugggucauguaugggacuugcacucaaaguggagaaagaagaagagagaaaagaaguguagccuuaacaccacacagcggaaugggauuagaaacaagagcagaaacguggaugaguagugaaggggcuuggaaacacgcacaaagaguagaaaguuggauacuaaggaacccuggguuugcuuuacuagcaggauuuauggcauauaugauaggccaaacagggauacaaagaacuguauucuucguacuaaugauguuaguagcaccuaguuauggaaugcguuguguaggagugggaaacagagacuucguagaaggaguaagugggggagcauggguagauuuaguauuggaacaugguggaugcguaacaacaauggcacaaggaaaaccuacuuuagacuucgaacucacgaaaacaacagcaaaagaaguugcacuacuaagaacauauuguauagaagcaaguauaucaaacauaacaaccgcuacgagauguccaacucaaggugaaccauaucuuaaagaagaacaagaucaacaguauauaugcagacgcgauguaguagacagaggaugggggaauggauguggauuauuuggaaaaggaggaguaguaacaugugcgaaauuuaguuguaguggaaaaauaacugguaaucuuguacaaauagaaaauuuagaauacacagugguagugacagugcauaauggagauacgcaugcaguaggaaaugauacaaguaaucauggaguaacugcuacaauaacaccaagaaguccaucagucgaagugaaacuuccagauuauggagaacugacucuagacugugaaccuagaucaggaaucgauuucaacgaaaugauauuaaugaaaaugaaaaagaaaacauggcuuguccauaaacaaugguucuuagauuuaccacuaccauggacugcgggugcagauacaucugaaguacacuggaacuacaaagaaaggaugguaacuuuuaaaguuccgcaugcaaaaagacaggaugugacaguauuaggaucacaagaaggagcaaugcacagugcauuagcaggagcaacagaaguagacucaggugauggaaaucauauguuugcaggccauuuaaaauguaaaguaagaauggaaaaauuaagaaucaaaggaauguccuauacaaugugcagugggaaguuuucuaucgauaaagaaauggcagaaacgcaacauggaacaacuguaguuaaaguuaaauaugaaggagcaggagcaccuuguaaaguaccaauagaaauaagagacgugaauaaagaaaaaguaguaggaagaguuauaaguucaacaccucuagcugaaaauacuaauaguguuacaaauauagagcuagaaccgccauuuggagacaguuauauuguaauaggaguaggaaauucagcacuaacucuacauugguuuaggaaaggaagcaguauugguaaaauguuugaaagcacuuacagaggagcuaaaagaauggcaauacuaggggaaacagcaugggacuuuggaucagucggaggauuauuuacaagucuaggaaaagcaguacaccaagucuuuggcagcguauacacgaccauguucggaggaguaagcuggaugauaagaauuuuaauaggguuucuaguacuguggauugggacaaauucaagaaacacaagcauggcaaugacaugcauagcuguagguggcauuacauuauuuuuagguuuuacaguacaagcguaa

SEQ ID NO: 2256 - RNA, 2031 nt, Artificial Sequence
  derived and/or modified CDS sequence (opt6) from DENV-4 Consensus__SSc-prME(F108S)
augaguacaauaacacuacugugccugauaccaacaguaauggcauuucacuuaucaacaagagacggagaaccauuaaugauaguagcaaaacaugaaagagggagaccauuauuauuuaaaacuacagaagguauaaauaaauguaccuuaauagcaauggacuuaggagaaaugugcgaagauacagugacauacaaaugcccacuauuaguuaacacagaaccagaagacauagauuguugguguaaucuaacaaguacauggguaauguaugguacaugcacucaaucaggagaaagaaggcgcgagaaaagaagcguagcacuaacaccacacaguggaaugggauuagaaacaagagcagagacuuggaugaguagcgaaggagccuggaaacaugcacaaagaguagaaucauggauacuacgaaauccaggauuugcauuacuagccggauucauggcauauaugauuggacaaacaggaauacaaagaacugucuucuucguacuaaugauguuagucgcaccaucguacggaaugagauguguaggaguaggcaauagagauuuuguugaaggaguaaguggaggagcauggguugauuugguguuagaacauggaggaugcguaacaaccauggcacaaggaaaaccgacauuagauuucgagcuaacaaaaacaacagcaaaggaaguagcauuauuaagaacauauugcauagaagcaucaauaucuaauauaacaacagcuacaagauguccaacacaaggcgaaccauaucuaaaagaagaacaagaccagcaguacauaugccgacgugacguaguagacagaggguggggaaauggaugcggacuaucagggaaaggaggcguagucacuugugcaaaauucucauguaguggaaaaauaacagguaacuuaguucaaauugaaaaccuggaauauacaguuguagucacaguacauaacggagauacacaugcagucggaaaugacacaaguaaucaugguguuacugcaaccauuacaccaagaaguccaagcguagaaguaaaguuaccugauuauggagaacuaacauuggauugugaacccagaucaggaauagacuuuaaugaaaugauauuaaugaaaaugaaaaagaaaacaugguugguacauaaacagugguuuuuagauuugccacuaccauggacagcaggagcagauacaucagaaguacauuggaauuauaaagaaagaauggucacguuuaaaguuccucaugcuaaaagacaagacguaacaguauuaggaucacaagaaggagcaaugcauagugcauuagcuggagcaacagaaguagauaguggagauggaaaucauauguuugcaggacauuuaaaauguaaaguaaggauggaaaaauuaagaauaaaggguaugaguuacacaauguguucaggaaaauucucaaucgauaaagaaauggcagaaacacaacauggcacaacaguaguaaaaguaaaauacgagggggccggugcacccuguaaaguuccaauagaaauaagagacguaaauaaagaaaaaguaguagguagaguaauaaguagcacaccauuggcagagaacacaaauucagugacuaacauagaacuggaaccaccuuuuggagauaguuacauaguaauaggaguuggaaacucagcuuuaacauuacauugguucagaaaaggaucaucgauaggaaaaauguuugaaaguacuuauagaggcgccaaacgaauggcaauauuaggagaaacggcuugggauuuuggaagugucggagguuuauucacaucucuaggaaaagcaguacaucaaguauuugggaguguauauacaacaauguucggagggguuagcuggaugauaagaauauuaauaggauuuuuaguauuauggauaggaacgaacucaagaaauacauccauggcuaugacauguauagcuguaggaggaauuacacuauuucucggcuucacaguacaagccuaa

SEQ ID NO: 2257 - RNA, 2031 nt, Artificial Sequence
  derived and/or modified CDS sequence (opt6) from DENV-4 Consensus__SSc-prMEdelstem_TM-JEV
augaguacaauaacauuguuaugccuaauaccaacaguaauggcauuccauuuaagcacaagagauggugaaccacuuaugauuguagcaaagcaugaaagaggaagaccuuugcuauuuaaaacaacagaagguauaaacaaauguacauuaauugcaauggauuuaggggaaaugugcgaagauaccguaacauauaaguguccacuacucguaaauacggaaccugaagauauagacuguugguguaaucucacuucaacuuggguuauguaugguacauguacacaaucuggugaaagaagaagagagaaaagaaguguagcuuuaacgccacauucagggaugggauuagaaacuagagcagaaacauggaugagcagugaaggagcauggaaacacgcacaaagaguagaaagcuggauuuuaagaaauccaggauucgcauuguuggcaggauuuauggcauacaugauuggacaaacaggaauacaaagaacaguauucuuugucuugaugauguuaguagcuccuucauauggaaugcguuguguaggaguggguaaucgagauuuuguagaaggaguaagcggaggagcauggguagacuuaguauuagaacauggaggauguguuacaacaauggcacaaggaaaaccaacauuagacuuugaacucacaaaaacaacagcaaaagaaguagcacuauuaaggaccuauugcauagaagcgagcauaucaaacauaacuacagcaacuagguguccuacacagggggaaccauaccuuaaagaggaacaagaccaacaauacauuugcagacgagauguagucgaucggggauggggcaaugguuguggacuauuuggaaaaggaggagugguaacuugcgcuaaauuuaguuguaguggaaaaauaacaggaaaccuaguacaaauugaaaacuuagaauauacaguaguuguaacaguacacaacggagauacucaugcaguaggaaaugacacuagcaaucauggaguaacagcgacaauaacuccuagaagucccaguguagaaguaaaauuaccagauuauggagaauuaacauuagacugugaaccaagaaguggaauagauuuuaaugaaaugauacuuaugaaaaugaaaaagaaaacaugguuaguacauaaacagugguuuuuagacuuaccuuuaccauggacagcaggagcagauacaagugaaguucauuggaacuauaaagaacgaaugguuacuuuuaaagugccacaugcgaaaagacaagauguuacuguauuaggaucacaagagggcgcaaugcauagugcucuagcaggagcaacagaaguugauaguggagaugggaaucauauguuugcaggacacuuaaaauguaaaguaaggauggaaaaguuacggauaaaaggaaugagcuauacaauguguaguggaaaauuuucaauagauaaagaaauggcagaaacccaacauggaacaacaguaguuaaaguaaaguaugaaggagcuggugccccauguaaggugccaauagaaauuagagacguaaauaaagagaaaguaguaggaagagugauaaguagcacaccguuagcugaaaauacgaauagcguuacaaauauagaguuagaaccaccuuuuggcgauagcuauauaguaauaggaguaggaaauagugcacugacuuuacacugguuuagaaagggcucaaccuuaggaaaagcguuuagcacuacauuaaaaggggcacaaagauuagcagcucuaggagauacugcuugggauuuugguucaauuggaggcguauuuaauucaauuggucgugcgguacaucaaguauuugggggagcauucagaacacuauucggaggaaugucauggauaacacaaggauuaaugggcgcacuucuacuauggauggggguuaaugcuagagacagaucuauagcguuagcuuuucuugcaacgggagguguccuaguuuuucuugcuacuaauguacacgcuuaa

SEQ ID NO: 2258 - RNA, 1332 nt, Artificial Sequence
  derived and/or modified CDS sequence (opt6) from DENV-4 Consensus__SSm-EdelTM
augauacaaagaacaguauucuuuguauuaaugauguuaguagcaccaagcuaugguaugagauguguaggaguaggaaauagagauuuuguagaaggagugaguggaggggcauggguagacuuaguacuagaacauggaggauguguuacuacaauggcucaaggaaaaccaacccuagauuuugaacuaaccaaaacaacagcaaaagaaguugcauuauuaagaacauacugcauagaagcgagcauaaguaauauaacaacagcgacaagaugcccaacucaaggagaaccauaucuaaaagaagaacaagaucaacaauauauaugucgaagagauguaguugauagaggauggggaaacgguuguggauuauucggaaaaggaggcguaguaacaugcgcaaaauuuaguuguagcggaaaaauaacaggaaaucuaguucaaauagaaaauuuagaauauacaguaguuguaacaguacacaauggagauacucaugcaguaggaaaugacacaaguaaucacggagucacugccacaauaacaccaagaaguccuaguguggaaguaaaauuaccagauuacggagaauuaacgcuagacugugaaccacgaagcggaauagauuuuaacgaaaugauacuuaugaaaaugaaaaagaaaacauggcuaguucacaaacaaugguuccuagauuuaccauugccauggacagcaggagcagauacgagcgaaguacacuggaauuauaaagaacgaaugguaacauucaaaguaccacacgcuaaaagacaagacguaacgguauuaggaucacaagaaggagcaaugcauucagcauuagcgggagcaacagaaguagauagcggagauggaaaccacauguuugcaggacauuuaaaauguaaagucagaauggaaaaauuaagaauaaaaggaaugaguuacacaaugugcaguggaaaauucucaauagauaaagaaauggcagaaacacaacaugguacaacagugguaaaaguaaaauaugaaggagcaggagcaccauguaaaguaccuauagaaauacgugauguuaacaaagaaaaaguaguaggaagaguaauaucaucaacaccacuagcagaaaauacgaacaguguaacaaauauugaauuggaaccaccuuucggagacucauauauaguaauaggaguaggaaacucagcacuaacuuuacauugguuuagaaaaggaucaaguauaggaaaaauguucgaaucaacauacagaggagcaaaaagaauggcaauauuaggggaaaccgccugggauuuuggaucuuaa

SEQ ID NO: 2259 - RNA, 2376 nt, Artificial Sequence
  derived and/or modified CDS sequence (opt6) from DENV-4 Consensus__C-P2A-SSc-prME
augaaccaaagaaagaaagucguaagaccaccauuuaacauguuaaaaagagaacgaaauaggguuaguacaccacaaggguuagugaaaagauucaguacugguuuauuuaguggaaaaggaccgcuacgaaugguacuagcauuuauuaccuuucuaagaguauugucaaucccaccaacagcaggcaucuugaaacgauggggacaacuuaagaaaaacaaagcuauaaaaauauuaauaggauuuagaaaagaaauagguagaauguuaaauauacuaaauggacgaaaacgaaacuucgaucuacuaaaauuagcaggggauguagaaucaaaucccggucccaguacaauaacgcuguuaugucuaauaccaacaguaauggcauuccauuuaucuacaagagacggagaaccauuaaugauaguagcaaaacaugaaagggggagaccccuacuauuuaaaacaacagaaggaauaaauaaauguacucugauagccauggaccuaggagaaaugugugaagauacuguaacauacaaaugcccucuauuaguaaauacagaaccugaggauauagauuguugguguaauuugacaaguacuuggguaauguacggaacguguacacaaucgggugaaaggagaagagagaaaagaagcgucgccuuaacaccacauaguggaaugggucuggaaacacgagccgaaacauggaugucuagugaaggagcuuggaaacaugcucaaagaguugaaaguuggauacuacguaaucccggauuugcucuauuagcagguuucauggcauauaugauaggacaaacaggaauacaacgaacaguauucuuuguacuaaugauguuaguagcaccaucauauggaaugagaugcgucggaguuggaaaucgugauuucguagaagguguaagcggaggagcauggguugacuuagucuuagaacauggagguugcguaacaacuauggcacaagguaaaccaacucuagauuuugaauuaacaaaaacaacagcaaaagaaguugcauuguuaagaacauacuguauagaagccucuauaucuaacauuacuacggcaacaagaugcccuacacaaggugagccuuauuuaaaagaggaacaagaucaacaauauauauguagaagagacguaguagaucgagguuggggaaaugguuguggcuuauuugggaaaggaggaguaguuacaugugcaaaguucucguguucugguaagauaacaggaaaccuaguccaaauagaaaauuuagaauauacaguugugguaacaguacacaacggagacacucaugcagucgguaaugacaccucaaaccaugguguaacagcaacaauuacacccagaaguccgaguguagaaguuaaacugccggauuauggagaauuaacuuuagacugugaacccagaagcggaauagauuuuaaugaaaugauauuaaugaagaugaaaaagaaaacauggcucguacauaaacaaugguuuuuggaucuaccgcuuccguggacagcaggcgcagauacaucagaaguacauuggaauuacaaagaaagaaugguuacauucaaaguaccacaugcaaagcgacaagacgugacaguacucgguagccaagaaggagccaugcauagcgcguuagcaggagcaacagaaguagauucaggugacggaaaucacauguuugcaggucaucuaaaaugcaaaguaaggauggaaaaacuaagaauaaaaggaaugagcuauacaauguguucaggaaaauuuucaaucgacaaagaaauggcagaaacccaacacgguacaacaguuguuaaaguaaaauacgaaggggcuggugcaccuuguaaaguuccaauagaaauaagagauguuaauaaagaaaaaguaguuggaaggguaauaucuagcacaccacuggcagaaaauacaaacaguguaacaaauauugaacuagaaccucccuuuggagauaguuauauaguuauaggcguagguaauagcgcccuaacacuacauugguuuagaaaagguagcagcauagguaaaauguuugaaucaacauauagaggagcuaaacgaauggcaauacuuggagaaacugcaugggauuuugguucaguaggcggauuauuuacaaguuuggguaaagccguacaucaaguauucgggucgguauauacuacuauguuuggaggcgucaguuggaugauaagaauuuuaaucggauuuuuaguacuguggauagguacaaauucaagaaacacgagcauggcaaugacauguauagcaguaggugggauaacauuauuuuuaggcuucacaguacaggcauaa

SEQ ID NO: 2260 - RNA, 2043 nt, Artificial Sequence
  derived and/or modified CDS sequence (opt6) from DENV-4 Consensus__SSopt-prME(F108S)
augaaaagaaagaaaagcacaauaacacuauuaugcuugauaccaacaguaauggcuuuccauuuaagcacacgugauggagaaccacuaaugauaguagccaaacaugaaagggguaggccuuugcuuuuuaaaacaacugaagguauaaauaagugcacgcuaauagcaauggaucuaggagagaugugugaagauacaguuacauacaaaugcccuuuguuaguuaauacggaaccagaagauauagacugcugguguaacuuaacgaguacauggguaauguauggaacaugcacccagaguggggaaagaagaagagagaaaagaaguguagcauuaacaccacauucagggaugggauuagaaaccagagcagaaacauggaugaguagcgaaggagcauggaaacacgcacaacgaguagaaagcuggauauuaagaaacccaggcuuugcacucuuagcggguuucauggcauacaugauaggccaaacaggaauacaaaggacuguauuuuucguucuaaugaugcuuguagcaccuaguuaugggaugagaugcguuggagucggcaauagagauuucguagaaggaguaagugguggagcauggguagauuuaguauuagaacauggagguugcguaaccacaauggcgcaaggaaaaccaacauuagauuuugaauuaacgaaaacaacugcaaaagaaguggcacuauuaagaacauauugcauagaggcuaguauaaguaauauuacaacagcaacaagaugcccuacacagggagagccuuauuuaaaagaagaacaagaccaacaguauauaugcagaagagauguaguagacagaggauggggaaauggguguggauuaaguggaaaaggagggguagugacaugugcaaaauuuucuuguagugguaaaauaacaggaaaucuaguucagauagaaaauuuggaauauacaguaguagugacaguacauaauggggauacacaugcgguagguaaugacacaucaaaucacggaguaacagccacgauuacaccaagaaguccuaguguugaaguaaaguuaccugauuauggagaauuaacuuuagacugugaaccgaggagcggaauagauuuuaaugaaaugauuuuaaugaaaaugaaaaagaaaacauggcugguacacaaacaaugguuccuagauuuaccacuaccauggacagccggagcagauacaagugaaguacacuggaauuauaaagagcgaaugguaacuuuuaaaguaccacaugcaaagagacaggauguuacaguccuaggaagucaagaaggagcaaugcauucagcauuagcaggagcgacagaaguagauagcggggauggaaaucauauguucgcagggcauuuaaaauguaaaguaagaauggaaaaacuucgaauaaaagguaugaguuacacuauguguagcggaaaguuuucuauagacaaagaaauggcagaaacgcaacauggaacaaccgugguaaaaguaaaauacgaaggagcgggagcaccauguaaaguaccaauagaaauacgagauguaaauaaagaaaaaguaguuggcagaguaauuaguaguacacccuuggccgaaaauacaaacagcguaacgaacauagaacuagaaccgccguuuggagauagcuacauaguaauaggaguaggaaauucugcuuuaacauuacauugguuuagaaaagguaguaguauuggaaaaauguucgaaucaacguauagaggagcaaaaagaauggcaauauuaggagaaacagcaugggacuuuggaaguguaggagguuuauucaccaguuuagggaaagcaguacaucaaguauuugggaguguguauacuacaauguuugggggaguaagcuggaugauaaggauauuaauaggauuuuuaguauuauggauaggaacuaauagcagaaauacaucaauggcaaugacauguauugcagucggaggaauaacauuauuucuuggauuuacgguacaagcauaa

SEQ ID NO: 2261 - RNA, 2043 nt, Artificial Sequence
  derived and/or modified CDS sequence (opt6) from DENV-4 Consensus__SSopt-prME(V96H)
augaaaagaaagaaaaguacaauaacacuauuaugucuaauaccaacaguaauggcauuucacuuaaguacaagagacggagaaccauuaaugaucguagcuaaacaugaacgaggaagaccuuuacuauucaaaacgacagaaggaauuaauaaaugcacacuuauagcaauggauuuaggagaaaugugugaagacacaguaacauauaaaugcccauuguuagucaacacagaaccagaagauaucgacuguugguguaauuuaacaagcacguggguaauguauggaacauguacucaaucaggugagagaaggagagaaaaacgaaguguugcauuaacaccacauuccggaaugggucuagaaacacgagccgaaacguggaugaguucagaaggagcguggaaacaugcgcaaaggguggaaucauggauacuaaggaauccugguuuugcacuacuagcgggcuuuauggccuauaugauaggacaaacagggauucaaaggacaguuuucuuuguacuaaugauguuaguagcuccaucauauggaaugcgauguguaggagucggaaauagagauuuuguagaaggaguaucggguggagcauggguugauuugguauuagaacacggcggauguguaacaaccauggcucaaggcaaacccacauuagacuuugaauuaacuaaaacaacugcaaaagaaguugcgcuauuaaggacauauuguauagaagcaagcauauccaauauaacaacugcaacuaggugcccaacacaaggugaaccauauuuaaaagaagaacaagaucaacaauacauauguaggcgagaucauguugauagagguuggggaaaugguuguggacuauuuggaaaaggagguguuguaacaugugcaaaauuuucaugcaguggaaaaaucacagggaaccuaguacagauagaaaaucuagaauauacagugguuguaacaguacauaauggugauacacaugccguaggaaaugauacaagcaaucauggaguaacagcaacaauuacuccaagaucuccaucagucgaagugaaauuaccagauuauggggaguugaccuuagauugcgaaccaaggagcgggauagauuuuaaugaaaugauacuaaugaaaaugaaaaagaaaacuuggcuaguucacaaacaaugguuucuagacuuaccuuuaccauggacagcuggggcagauacgucagaaguacauuggaacuauaaagaaagaaugguaacauucaaaguaccacaugcaaaaagacaggauguaacagugcuaggaucacaagaaggagcaaugcauagugcauuggccggugcaacugaaguagacaguggagaugguaaucauauguuugcaggacauuuaaaauguaaagugagaauggaaaaacuuagaauuaaaggaaugaguuauaccaugugcucaggcaaauucucaauugauaaagaaauggcagaaacacaacauggaacaacaguaguaaaagucaaauaugaaggugcuggagcaccauguaaaguaccaauugaaauuagagauguuaauaaagaaaaaguugucggaagaguaauaaguaguacaccuuuagcagaaaauacuaacaguguaacaaauauugaacuugaaccgccuuuuggagacagcuacauaguuauagguguaggaaauagugcccuaacuuuacacugguuuagaaaaggaucgagcauaggaaaaauguuugaaaguacauauagaggugcuaaaagaauggcaauuuuaggugaaacagcuugggacuuuggaucaguagguggauuauuuacaagucuagggaaagcaguacaccagguuuuugguaguguauauacaacuauguuuggagggguaaguuggaugauaaggauuuuaauaggcuuuuuaguauuauggauuggaacaaauucuagaaauaccaguauggcuaugacuuguauagcaguugguggaauaacauuauucuuaggauucaccguacaagcauaa

SEQ ID NO: 2262 - RNA, 2043 nt, Artificial Sequence
  derived and/or modified CDS sequence (opt6) from DENV-4 Consensus__SSopt-prME(E186F)
augaaaaggaagaaaucaacuauaacauuauuaugccuuauuccgacaguaauggcauuucaucugucaacaagagauggcgagccguuaaugauuguagcaaaacaugaaagaggaagaccauuguuauuuaaaacgaccgagggaauuaauaaaugcacauuaauugcaauggaccugggcgaaaugugugaagauacaguuacuuauaaauguccauuauuaguuaauacggaaccagaagauauagacuguugguguaaucuaacaucaacuuggguaauguauggcacauguacacaaucaggagaaagaagaagagagaaaaggaguguggcguuaacaccacauucaggaaugggauuggaaacaagagcagaaacuuggaugaguucugaaggcgccuggaaacacgcacaaagaguggaaaguuggauauugagaaacccagguuucgcauuauuagcaggauucauggcguacaugauaggacaaacagggauacaaagaacaguauuuuucguuuuaaugaugcuaguugcaccaucauauggcaugagauguguaggaguaggaaauagagauuuuguagaaggaguaagcggaggagcauggguagacuuaguacuagaacacggagggugugugacuacuauggcacaagggaaaccuacacuagauuuugaauuaacuaaaacaacagcaaaagaaguagcacuacuaaggaccuauugcauagaagcaagcauaaguaacauaacaacagccacgagaugcccaacccaaggugaaccauacuuaaaagaagaacaagaccaacaguacauauguagaagagauguuguagacagaggauggggaaauggcuguggauuauuuggcaaaggggguguaguaacaugugcaaaauuuaguuguaguggaaaaauuacaggcaauuuaguccaaauagaaaacuuagaauauacaguaguaguaaccguucacaauggcgacacacaugcaguagguaacgauacgaguaaucauggaguuacagcuacgauaacaccaagaaguccaucaguagaaguaaaauuacccgauuauggagaacuaacauuagauuguuucccucgaagcgguauagauuuuaaugagaugauacucaugaaaaugaaaaagaaaacuugguuaguacacaaacaaugguuucuagacuuaccauuaccuuggacagcaggagcugacacaagugaaguacauuggaauuauaaagaaagaaugguaacauuuaaaguuccacaugcaaaaagacaagauguuacgguauuaggaucacaagaaggagcaaugcauagugcacuagcuggugcaacugagguagauagcggggauggaaaucacauguuugcaggucaucuaaaauguaaaguaagaauggaaaaauuaagaauaaaagguaugaguuacacaaugugcucaggaaaauuuucuauagacaaagaaauggcagagacacaacaugggacgacgguaguaaaaguaaaauaugaaggagccggagcgccguguaaaguacccauugaaauaagagauguuaauaaagagaaaguaguaggaaggguaauaucgucaacgccauuagcagaaaauacaaauaguguaacaaauauagaacuagaaccuccauucggagauaguuauauaguuauaggaguagggaauagugcgcuaacguuacauugguuuagaaaaggaagcucaauaggcaaaauguucgagagcacauaucgaggagcaaaaagaauggcaauauuaggggaaacagcaugggauuucggaucuguagggggacuuuucacuucauuaggaaaagcaguacaucaaguauuuggauccguauauaccacaauguuuggagguguuucuuggaugauaagaauuuuaauagguuuucuaguacuauggauaggaacuaauaguagaaauacaagcauggcaaugacuuguauagcaguaggaggaauaacacuauuuuuaggauuuacaguucaagcauaa

SEQ ID NO: 2263 - RNA, 2043 nt, Artificial Sequence
  derived and/or modified CDS sequence (opt6) from DENV-4 Consensus__SSopt-prME(R188L)
augaaaagaaagaaaucaacgaucacauuauuaugucucauaccaacaguaauggcauuccaccuaagcacuagagauggagaaccgcuaaugauuguagcaaaacaugaaagagggagaccuuuacuauuuaaaacaacagaaggaauaaauaaaugcacucuaaucgccauggacuuaggagaaaugugugaagacacagucacuuauaaaugcccacuauuaguaaauacugaaccagaagauauagacuguugguguaauuuaacaaguacaugggugauguaugguacuuguacacagaguggagaaagaagaagagaaaagagaaguguagcauuaacuccccauucuggaaugggucuggaaacaagagcagaaacguggaugaguucagaaggagcauggaaacacgcgcaacgaguagaaagcuggauacucaggaauccuggauuugcacuacuggcggguuuuauggcuuauaugauaggacaaacaggaauccagagaacaguuuucuuuguauuaaugaugcuaguagcuccaaguuauggaaugcgaugcguaggaguagggaauagagacuuuguagaaggaguaucaggaggugcauggguugaccuuguauuagaacauggagguugugugacaaccauggcacaaggaaaaccaacacuagauuuugaauuaacaaaaacaacugcaaaagaaguagcguuauuaagaacauacuguauagaagcgaguauaagcaacauaacaacagcuacaaggugcccaacucaaggggaaccauaucuaaaagaagaacaggaucaacaguacauaugcagaagagauguuguagauagaggauggggaaauggauguggccuauuugguaaaggaggaguaguaacaugcgcaaaauuuagcuguaguggaaaaauaacaggaaaccuaguacagauagaaaauuuagaauauacugugguaguaacagugcacaauggagauacucacgccguagguaaugacacaucaaaucauggaguuacugcuacuauaacaccgagaucaccaucaguagaaguaaaauugccagauuacggugaauuaacacuagauugugaaccauuaaguggaauagauuucaaugaaaugauacuaaugaaaaugaaaaagaaaacaugguuagugcauaaacagugguuucuugauuuaccguuaccguggacagcaggagcagacacaagcgaaguacauuggaauuauaaagaaagaaugguuacauuuaaaguaccacacgcuaaaagacaagauguuacuguacuuggaucacaagaaggugcaaugcacagugcacuagcaggagcgacagaaguagauucuggggacggaaaucacauguuugcaggacauuugaaauguaaagugcgaauggaaaaacuaagaauaaaaggaaugucauacacaauguguagugguaaauucaguaucgauaaggaaauggcagaaacacaacauggaacaacaguaguaaaaguaaaauaugaaggagccggugcaccauguaaaguaccgauagaaauaagagaugucaacaaagaaaaaguagucggacgagugauuucuagcacaccuuuagcggaaaauacaaacucaguaacgaauauagaacuagaaccucccuucggagauaguuauaucguaauaggaguaggaaauucagcauuaacauuacauugguuuagaaaaggaagcucaauagguaaaauguuugaaaguacguauagaggagcaaaaagaauggcaauuuuaggagaaacugcaugggauuucgggucaguaggaggauuguuuacaucacuaggaaaagcaguacaucaaguuuucggaagcguauauaccaccauguuuggaggaguuagcuggaugauaagaauacuuauaggauuucuaguucuauggauaggaacaaauaguagaaacacaucaauggcaaugacauguauugcaguaggggguauuacauuauuuuuagguuuuacaguacaagccuaa

SEQ ID NO: 2264 - RNA, 2043 nt, Artificial Sequence
  derived and/or modified CDS sequence (opt6) from DENV-4 Consensus__SSopt-pr(D104A)MEdelstem_TM,(F108S)-JEV
augaaaaggaaaaagaguacaauaacuuuauuaugccuaauaccaacaguuauggcauuucaucuaagcacaagagacggagaaccuuuaaugauuguagccaaacacgaaagaggaagaccacuauuauuuaaaacaacagaaggaauuaauaaauguacacuaauagcaauggauuuaggagaaaugugugaagacacaguuacuuauaaaugcccacuauuagugaauacagagccagaagauauagauuguuggugcaauuuaacgaguacauggguuauguaugguacaugcacacaaaguggagaaagaagaagggcaaaacgaucuguagcauuaacaccucacuccggaaugggacuagaaacaagagcagagacauggaugaguagcgaaggagcauggaaacaugcacaaagaguagaaagcuggauauuaaggaacccagguuuugcauuguuagcuggauuuauggcguauaugaucggacaaacaggaauacagagaacaguauucuuugucuuaaugauguuaguggcacccaguuacggaaugcgauguguagggguggguaauagagauuucguagaaggcgugucaggaggcgccuggguagauuuaguacuagaacacggaggcuguguuacaacuauggcacaagguaaaccaacacuagauuucgaacuaacuaaaacaacagcaaaagaaguagcauuauuaagaacauauuguauagaagcaaguauaucgaauauaacaacggcgacgagauguccaacacaaggagaaccauauuuaaaagaagaacaagaucaacaauauauaugucgacgagauguaguagauagaggauggggaaacggauguggacuaagugggaaaggaggaguaguaacaugcgcaaaauucuccuguaguggaaaaauaacaggaaauuuaguucaaauagaaaauuuggaauauacagugguaguaacaguacauaacggugauacacaugcaguaggaaacgauacuucaaaucauggaguaacagcaacaauaacuccaagaaguccgaguguagaggucaaauuaccugauuacggagagcuaaccuuagacugugaaccccgaucaggaauugauuuuaaugaaaugauauuaaugaaaaugaaaaagaaaacauggcuaguacauaaacagugguuuuuagacuuaccacuaccauggacugcaggggcagauacaucagaaguacauuggaacuauaaagaacgaaugguaacuuuuaaagucccacaugcaaaacgacaagaugucaccguacucggaucacaggaaggagcaaugcacucugcauuagcaggagcaacugaaguagauaguggagacggaaaucauauguuugcaggacaucuaaaauguaaagucagaauggaaaaacuaagaauaaaaggcaugucauauacaauguguagcggaaaauuuaguauagacaaagaaauggcagaaacacaacacggaacuacaguaguaaaaguaaaauaugaaggugcuggcgcuccauguaaaguuccuaucgaaauaagagauguuaauaaagaaaaaguaguagggcgaguaauuucaucaacgccauuggcggaaaauacaaacaguguaacaaauauagagcuagagccaccauuuggagacaguuauauagucauagggguaggaaauagugcuuuaacacuucauugguuucgaaaaggaucaacauuaggaaaagcguuuucaacaacucugaaaggagcgcaaagacuagcagcuuuaggugacacugcaugggacuuuggaaguauugguggaguuuuuaauucaauagguagagcaguacaucaaguauuuggaggagcauuuagaacauuguuugguggaaugaguuggauaacucagggcuuaaugggagcacuauuauuauggaugggcguaaaugcuagagacagaucuauugcauuagcauuuuuagcaacuggaggaguauuaguguucuuagcaacgaacguacaugcauga

SEQ ID NO: 2265 - RNA, 2043 nt, Artificial Sequence
  derived and/or modified CDS sequence (opt6) from DENV-4 Consensus__SSopt-prMEdelstem_TM,(H261N)-JEV
augaaacgaaagaaaaguacaauaacauuguuauguuuaauaccaaccguuauggcauuucacuuaucaacuagagauggugaaccuuuaaugauaguagccaaacaugaaagaggaagaccauuauuauuuaagacaacagaagguauaaacaaauguacuuuaauagcaauggaucuaggagaaaugugugaagacacaguaacauauaaauguccacuacuugugaauacggaaccagaggauauagacuguugguguaauuuaacaucaacauggguaauguacggaacauguacacaaaguggagaaagacggagggagaaaagaucaguagcauuaacaccacauaguggaaugggguuagaaacacgagcagaaacauggaugagcucagaaggagcauggaaacaugcacagagaguagaaucauggauauugagaaauccaggcuucgcauugcuagcuggauucauggcauauaugauaggacaaacgggaauacaacguacaguuuucuuuguucuaaugauguuaguagcaccgaguuauggaaugagauguguaggagucggaaauagggacuuuguagaaggaguaucaggcggagcguggguagacuuaguacuagaacauggcggauguguaacgacaauggcacaagguaaaccaacauuagauuuugaauuaacuaaaacaacagcaaaagaaguagcacuauuaagaacauacugcauagaagcauccauaaguaauauaacaaccgcaacacgaugcccaacacaaggugaaccauaucuuaaagaagaacaagaccaacaguauauuugcagaagagauguuguagauagaggcuggggaaauggauguggauuauuugggaaaggugguguagucacaugugccaaauuuucaugcagugggaaaauuacagggaauuuaguacaaauagaaaaucuagaauacacuguaguaguaacggugcacaauggagauacacaugcgguaggaaaugauacgucaaaucauggaguaacagcuacaauaacaccaagaaguccaucuguagaaguaaaacuaccugauuauggagaauuaacauuagauugcgaaccuagaagcgguauagauuuuaaugaaaugauauuaaugaaaaugaaaaagaaaacaugguuaguccauaaacaaugguuucuagauuuaccauugccauggacagcaggcgcagauacaagugagguucauuggaacuauaaagaaagaaugguuacauuuaaagugccacaugcaaaaagacaagauguaacaguccuaggcucucaagagggggcuaugaauagugcuuuagcaggggcgacagaaguagauaguggagauggaaaucacauguuugcaggucacuuaaaauguaaaguaagaauggaaaaacugagaauuaaaggaaugagcuauacuauguguagugguaaauuuucaauagauaaagaaauggcggaaacacaacauggaacaacaguuguaaaaguaaaauaugaaggagcuggagcaccaugcaaaguacccauugaaauaagagauguaaacaaagaaaaagugguagggagagugauaaguagcacgccgcuagcagaaaauacaaauucagucacaaacauugaauuagaaccaccuuuuggagacaguuauauaguaauagguguaggaaauagugcauuaacguuacacugguucaggaaaggaucuacuuuaggaaaagcauuuucaacaacgcuaaaaggagcacagcgauuagcggcacuaggagauaccgcuugggauuucggcagcauagguggaguuuuuaauaguaucgguagagcgguacaucaaguuuuuggaggagcauuuagaacacuauucggaggaaugucauggauuacacaaggacucaugggcgcuuugcuauuauggaugggaguaaaugcaagagauagaucaauagcauuagccuuucucgcaaccgguggagucuuaguauuucuugcuacuaauguucacgcauaa

SEQ ID NO: 2266 - RNA, 2043 nt, Artificial Sequence
  derived and/or modified CDS sequence (opt6) from DENV-4 Consensus__SSopt-prMEdelstem_TM,(R188L,A267T)-JEV
augaaaaggaagaaaagcacaauaacauuauuaugucuaauaccgacaguaauggcauuucacuuaaguacgcgagauggcgaaccacuaaugaucguggcaaaacacgaacgaggaagaccauuauuauucaaaacuacagaaggaauaaauaaauguacacuaaucgcuauggaccuuggagaaaugugugaagauacaguaacguauaaauguccauuauuagugaauacagaaccagaagauauugauuguugguguaaucuaacaucaacauggguaauguauggaacauguacccaaagcggagaacgaagaagagagaaaagauccguagcacuaacaccacauagcgguaugggacuagaaacuagggcagaaacauggaugucuagugaaggcgcauggaaacacgcacaaagaguggagaguuggauucuaaggaauccagguuucgcuuuauuagcggguuucauggcauauaugauaggacaaacuggaauacaaagaacaguauuuuucguuuugaugaugcuaguagcaccuucuuauggaaugagaugcguggguguaggaaacagagauuucguggaaggaguaagugggggagcauggguagaccuaguauuagaacacgguggauguguaacaacaauggcucaaggaaaaccgacacuagacuucgaauuaaccaaaacaacagcaaaagaaguagcauugcuuaggaccuacuguauagaggcaucaauaaguaacauaacaacagcgacaagauguccaacacaaggugaaccauaucuaaaagaagaacaagaucaacaauauauaugucgucgagacguaguagaccgaggguggggaaauggauguggauuauuuggaaaaggaggaguaguaacaugcgccaaauuuaguuguucaggaaaaauaacaggaaauuuaguucaaaucgaaaauuuagaauauaccguaguaguaacuguucauaacggagauacacacgcaguuggaaaugauacaucaaaucauggaguuacugcaacaauaacuccaagaaguccaucaguagaaguuaaacuaccagauuauggagaauuaacauuagauugcgaaccauuaagugguauagacuucaacgaaaugauauuaaugaaaaugaaaaagaaaacaugguuaguacauaaacaaugguuuuuagaucuuccucuaccauggacagcaggagcagauacaagugaagugcacuggaacuauaaagaacgaaugguaacauuuaaaguaccacaugcaaaaaggcaagacguaacaguauuggguagccaagaaggagcaaugcacagcgcacucgcagguacaacagaaguagauuccggagauggcaaucauauguuugcggggcacuuaaaauguaaaguaagaauggaaaaauuaagaauaaaaggcaugaguuauacaaugugcaguggcaaauucaguauagauaaagaaauggcagaaacgcaacauggaacaacuguaguuaaagugaaauaugaaggagcaggagcuccauguaaaguaccaaucgaaauaagagauguaaauaaagaaaaaguagucggaagaguaauaaguaguacaccauuagcagaaaacacuaacuccgugacaaauauugaauuggaaccaccauucggagauuccuauauaguaauugguguaggcaauagugcacugacacuccacugguuucgaaaagggucaacacuaggaaaagcauuuucaacaacauugaaaggagcacaaagauuagcagcacuaggggauacagcuugggacuucgggagcauaggaggaguauuuaauucaauagggagagcaguacaucaaguuuucgguggagcauucagaacguuauuuggaggaaugaguuggauaacgcaaggacuuaugggagcguuauuauuauggaugggaguaaaugcccgagauaggaguauagcuuuagccuuucuagcgacaggaggaguucucguauuuuuggcaacgaauguacaugcauaa

SEQ ID NO: 2267 - RNA, 300 nt, Artificial Sequence
  derived and/or modified CDS sequence (opt6) from DENV-3 Consensus__C
augaacaaccaaagaaaaaaaacaggaaaaccaagcauaaacaugcuaaaaagaguaagaaacagaguaagcacaggaucacaacuagcaaaaagauucagcaaaggacuacuaaacggacaaggaccaaugaaacuaguaauggcauucauagcauuccuaagauuccuagcaauaccaccaacagcaggaguacuagcaagauggggaacauucaaaaaaucaggagcaauaaaaguacuaaaaggauucaaaaaagaaauaucaaacaugcuaucaauaauaaacaaaagaaaaaaa

SEQ ID NO: 2268 - RNA, 342 nt, Artificial Sequence
  derived and/or modified CDS sequence (opt6) from DENV-3 Consensus__C-SSc
augaacaaccaaagaaaaaaaacaggaaaaccaagcauaaacaugcuaaaaagaguaagaaacagaguaagcacaggaucacaacuagcaaaaagauucagcaaaggauuacuaaacggacaaggaccaaugaaauuaguaauggcauucauagcauuccuaagauuccuagcaauaccaccaacagcaggaguacuagcaagauggggaacauucaaaaaaucaggagcaauaaaaguacuaaaaggauucaaaaaagaaauaucaaacaugcuaucaauaauaaacaaacgaaaaaaaacaagccuaugccuaaugaugauauuaccagcagcacuagca

SEQ ID NO: 2269 - RNA, 273 nt, Artificial Sequence
  derived and/or modified CDS sequence (opt6) from DENV-3 Consensus__pr
uuucacuuaacaucaagagauggagaaccaagaaugauaguaggaaaaaaugaaagaggaaaaagcuuacuauuuaaaacagcaucaggaauaaacaugugcacacuaauagcaauggacuuaggagaaaugugugacgauacaguaacauauaaauguccacauauaacagaaguagaaccagaagauauagacugcuggugcaaucuaacaagcacauggguaacauauggaacaugcaaucaagcaggagaacacagaagagauaaaaga

SEQ ID NO: 2270 - RNA, 225 nt, Artificial Sequence
  derived and/or modified CDS sequence (opt6) from DENV-3 Consensus__M
agcguagcauuagcaccacacguaggaaugggauuagacacaagaacacaaacauggaugagcgcagaaggagcauggagacaaguagaaaaaguagaaacaugggcacuaagacacccaggauuuacaauacuagcacuauuucuagcacacuauauaggaacaucacuaacacaaaaaguaguaauauuuauauuacuaaugcuaguaacaccaagcaugaca

SEQ ID NO: 2271 - RNA, 498 nt, Artificial Sequence
  derived and/or modified CDS sequence (opt6) from DENV-3 Consensus__prM
uuucacuuaacaucaagagauggagaaccaagaaugauaguaggaaaaaaugaaagaggaaaaagcuuacuauuuaaaacagccucaggaauaaacaugugcacauuaauagcaauggacuuaggagagaugugugacgauacaguaacauauaaauguccacauauaacagaaguagaaccagaagauauagauugcuggugcaaucuaacaagcacauggguaacauauggaacaugcaaucaagcaggagaacacagaagagauaaaagaagcguagccuuagcaccacacguaggaaugggauuagacacaagaacacaaacauggaugagcgcagaaggagcauggagacaaguagaaaaaguagaaacaugggcacuaagacacccaggauuuacaauacuagcacuauuuuuagcgcacuauauaggaacaucauuaacacaaaaaguaguaauauuuauauuacuaaugcuaguaacaccaagcaugaca

SEQ ID NO: 2272 - RNA, 1479 nt, Artificial Sequence
  derived and/or modified CDS sequence (opt6) from DENV-3 Consensus__E
augagauguguuggagucggaaauagagauuuuguagaaggauuaaguggagcaacauggguagauguaguacuagaacauggagguugugugacuacaauggcaaaaaacaaaccaacuuuagauauagaacuacaaaaaaccgaagcaacacaacuagcaacgcuacgaaaauuaugcauagaggggaaaauaacuaauauaacaacagauucaagauguccaacacaaggcgaagcaacacuaccagaagagcaagaccaaaauuauguauguaaacauacauauguugacagaggauggggcaaugguuguggacuauuuggaaaagggagucuaguaacaugugcaaaauuucaauguuuagaaccaauagaaggaaaaguaguacaauacgaaaauuugaaauacacaguaauaauaacuguacacacuggagaucaacaucaaguaggaaaugaaacccaaggaguaacagcagaaauaacgccacaagcaaguacaacagaagcaauauugcccgaauauggaacacuaggacuagaaugcaguccgaggacaggauuagacuuuaacgaaaugauacuauuaacaaugaaaaauaaagcauggaugguacauagacaaugguuuuuugaucuuccacucccauggacuuccggggcaacgacagaaacuccaacauggaauagaaaagaauuacuaguuacauucaaaaaugcacacgccaaaaaacaagaaguuguaguauuaggaagucaagagggugcuaugcauacagcacuuacaggagcaacagaaauacaaaacucaggaggaacaaguauauuugcuggacauuuaaaauguagauugaaaauggauaaauuagaacuaaaagguaugagcuaugcuauguguacaaauacauuuguacucaaaaaagaaguuucagaaacacaacacggaacaauuuuaauaaaaguugaauauaaaggugaagauguaccaugcaaaauaccauucaguacagaagauggacagggaaaagcucauaauggaagacuaaucacagcaaacccaguaguaacgaaaaaagaagaacccguaaacauagaagcugaacccccauucggagagaguaacauaguaauaggaauaggagauaaugcuuuaaaaauaaacugguauaaaaaaggaaguagcauuggaaaaauguuugaagcaacagcaaggggagcaaggagaauggcaaucuuaggagauacugcaugggacuuuggaaguguagguggaguacuaaacucauuaggaaaaauggugcaucaaauauuuggaagcgcauacacagcuuuauuuucaggaguaagcuggguaaugaaaauaggaauaggaguacuauuaaccuggauuggauuaaacagcaagaauacaaguaugaguuuuaguuguauagcaauaggaauaauaaccuuauauuuaggggcaguaguacaagca

SEQ ID NO: 2273 - RNA, 1977 nt, Artificial Sequence
  derived and/or modified CDS sequence (opt6) from DENV-3 Consensus__prME
uuucauuuaacuucgagggauggagaaccaagaaugauaguagggaaaaaugaaagaggaaaaaguuuacuuuuuaaaacugcgucaggaauaaacauguguacauugauagcaauggauuuaggagagaugugugaugacacaguaacauacaaauguccucauauaacagaaguagaaccagaagacauagauuguugguguaaccuuacaagcacauggguaacguaugggacuuguaaucaagcaggagaacaccgaagagacaaaagaagcguagcacuggcgccacauguagguaugggacuagacacaagaacucaaacauggaugucugcagaaggagcauggagacaaguagaaaaaguugaaacaugggcguuacgacauccggguuucacaauacuggcacuauucuuagcacacuauauaggaacuagccuaacacaaaaagugguuauauucauacuauuaauguuaguuacaccuaguaugacaaugcgaugugucggaguugggaacagagauuuugucgaaggauuaaguggggcaacauggguggauguaguauuagaacaugguggauguguaacaacaauggccaaaaacaaacccacauuagauauagaauugcagaaaaccgaggcaacacaauuagcaacauuaagaaaauuaugcauagaaggaaaaauaacaaauauaacaacugauucaagguguccaacucaaggcgaagcaacguuaccagaggaacaagaucaaaacuauguaugcaaacacacauauguagauaggggauggggaaauggauguggacuauuuggaaaaggaucauuaguuacaugugcaaaguuucaauguuuggaaccaauagaagguaaaguaguccaauacgaaaaucuaaaauauaccguaauuauaacaguacauacgggagaucaacaucaaguugguaaugaaacacaagguguaacagcagaaauaacaccacaagcaaguacuacugaagcaauauuaccagaauaugggacauuaggacuagaauguaguccaagaacaggacuagauuuuaaugaaaugauucuauuaaccaugaaaaacaaagcauggaugguacauagacaaugguuuuucgacuugccacuaccauggacuucaggagcaacaacagagacaccaacauggaacagaaaagaacuauuaguaacauuuaaaaaugcacacgcuaagaaacaagagguagugguacuagguucacaagaaggugcaaugcauacagcuuuaacaggagcaacagaaauacagaauagcgguggaacauccauuuuugcuggacaucuaaaauguagacuaaaaauggauaaauuagagcuaaaaggaaugaguuaugcaaugugcacaaauacauucguauuaaagaaagaaguuucagaaacacaacauggaacaauacuuauaaaagucgaauauaaaggagaagaugucccaugcaaaauuccuuuuucaacagaagauggacaaggaaaagcacauaacggacgacugauaacggcuaauccaguaguaacuaaaaaggaagaaccaguuaauauagaagcagaaccaccauuuggugaaucuaauaucguaauagggauuggugacaacgcauuaaaaauuaacugguacaagaaaggaaguaguauagguaaaauguuugaagcaacagcaaggggagcaaggaggauggcaauauuaggagauaccgcaugggauuuuggaucaguuggaggaguacuaaauaguuuaggaaaaaugguacaccaaauauucgggagugcuuauacugcacuauuuucgggcguaaguugggucaugaaaauagggauaggaguacuccuaacauggauaggacuaaauagcaaaaacacaaguaugaguuucagcuguauagcaauaggaauaauaacauuguauuugggggcaguuguacaagca

SEQ ID NO: 2274 - RNA, 2019 nt, Artificial Sequence
  derived and/or modified CDS sequence (opt6) from DENV-3 Consensus__SSc-prME
acaucacuaugcuuaaugaugauucuaccagcagcauuagcauuccacuuaaccucaagagacggagaacccagaaugauagucgguaaaaaugaacgaggaaaauccuugcuauucaaaacagcaucaggaauaaacaugugcacgcuaauugcuauggaucuaggagaaaugugugaugauacuguaacauauaaauguccacauauuacagaaguagaaccugaagauauagauuguugguguaaucuaacaagcacaugggucacauauggaacauguaaucaagcaggagaacauagaagagauaaaagaucaguugcguuagcaccacauguaggaaugggucuagacacgaggacacaaacauggaugucugcagaaggagcauggagacaaguagagaaaguugaaacaugggcauuaagacauccuggauuuacuauacucgcacucuuccuagcacacuauauaggaacaucacuaacacaaaaaguuguaauauuuauauuacugauguuaguaacuccaaguaugacaaugcguuguguagguguagguaacagagauuuuguagaaggauuaaguggagcuacauggguagauguaguccuagaacauggagguugcgugacaacaauggcgaaaaauaaaccaacauuagauauugaauuacagaaaacagaagcaacacaacuggcaacacuaagaaaacuaugcauagaaggaaaaauuacaaacauaacuacagauucaagauguccaacccaaggugaagcaacuuuaccagaagaacaagaucaaaauuauguuuguaaacauacauauguagauagaggcuggggaaauggauguggauuguuuggaaaagggagucuaguaacaugcgcaaaauuucaauguuuagaaccuauagaaggcaaaguaguacaauacgagaauuuaaaauauacaguaauaauaaccguacauacuggagaucaacaucaaguuggaaaugaaacgcaaggaguaacagccgaaauaaccccacaggcaucaacuacagaagcaauacuaccugaauacgguacuuuggguuuagaauguagcccacgaacagguuuagauuuuaaugaaaugaucuuauuaacaaugaaaaacaaagcauggaugguucauagacaaugguucuucgaucuuccauuaccauggacgaguggugcuaccacagaaacaccaacauggaauagaaaagaacuauuaguuacuuucaaaaaugcacaugcaaagaaacaagagguaguaguacuaggcucacaagaaggagcaaugcauacugcgcuaacgggcgcaacagagauacaaaacagugguggaaccucaauauuugcaggacacuuaaaauguagauuaaaaauggauaaauuagaacuaaaaggaaugucauaugcaauguguacaaacacguucguauuaaagaaagaaguuagugaaacacaacauggcacuauauugauaaaaguugaguacaaaggcgaagauguaccauguaaaauacccuuuagcacagaagauggacaaggaaaagcacauaacggaagacuaauaacugcaaacccaguaguuacaaagaaagaagaaccaguaaacauagaagcugaaccgccauuuggugaaucaaauauagugaucggcauaggagauaacgccuuaaaaauaaacugguauaagaaaggaagcucaaucggaaaaauguuugaagcaaccgcaagaggugcaaggagaauggcaauacuuggugacacagcaugggauuucggaaguguaggaggaguuuuaaacucacuaggaaaaaugguucaccaaauuuucggaagugcauacacagcuuuauucucuggaguaaguuggguaaugaaaauagguauaggaguauuauuaacauggauaggacuaaacagcaaaaacacaucgaugaguuuuaguuguauagcaauuggaaucauuacauuguauuuaggugcgguaguacaagca

SEQ ID NO: 2275 - RNA, 1056 nt, Artificial Sequence
  derived and/or modified CDS sequence (opt6) from DENV-3 Consensus__NS1
gacaugggauguguaauaaauuggaaaggaaaagaauuaaaaugcggaucaggaauauuuguaacaaaugaaguccacacauggacagagcaauacaaauuucaagcugacaguccaaaaagauuagcaacagccauagcaggagcaugggaaaacggagugugcgggauaagaaguacuacuagaauggaaaauuuacuauggaaacaaauagcaaaugaauuaaauuauauauuaugggaaaauaauauaaaauuaacaguaguuguaggagauauaauaggaguauuagaacaaggaaaaagaacauuaaccccacaaccaauggaauuaaaauacagcuggaaaacauggggaaaagcaaaaauagugacagcagaaacgcaaaauagcaguuuuauaauagauggaccgaacacuccugaauguccaagcguaagcagagcauggaacguaugggaaguagaagauuauggauuuggaguauuuacaacaaauauaugguuaaaauuaagagaaguguacacgcaauuaugugaucacagacugaugucagcagccguaaaagaugaaagagccgugcaugcagacaugggauauuggauagaaucacaaaaaaacggaaguuggaaauuagaaaaagccaguuuaauagaaguaaaaacaugcacauggccaaaaagucauacauuauggaguaaugguguacuugaaagugauaugauaauaccgaaaucauuagcaggaccaauaucacaacauaaucaucgaccaggauaucauacacaaacagcaggaccauggcacuuaggaaaauuagaauuagauuuuaauuauugugaagggacaacaguaguaauaacagaaaauugcggaacaagagguccaagcuuaagaacaacaacaguaucaggaaaauuaauacacgaaugguguuguagaaguugcacacuacccccacucagauacaugggagaggacggauguugguacggaauggaaauaagaccaauaagcgaaaaagaagaaaauaugguaaaaucauuaguaagcgca

SEQ ID NO: 2276 - RNA, 1857 nt, Artificial Sequence
  derived and/or modified CDS sequence (opt6) from DENV-3 Consensus__NS3
ucaggcguguuaugggauguaccaucaccaccagaaacacaaaaagcagaacuagaagaaggaguauacagaauaaaacaacaaggaaucuucggaaaaacacaaguaggaguagguguacaaaaagaagguguuuuccauacuauguggcacguaacaaggggugcaguguuaacguauaacggcaaaagauuagaaccuaacugggcuucggucaagaaagaucuaauuaguuauggaggagguuggcgauuaagcgcacaauggcaaaaaggcgaagaaguacaagugauagcaguagaaccagguaaaaauccgaaaaacuuucaaacaaugccaggaacauuccaaacaacuacaggagaaauaggagcaauagcauuagacuuuaaaccaggaacaucggguaguccaaucauaaaccgagaagguaaaguaguaggauuguacggaaauggaguaguaaccaaaaauggaggauauguaucaggaauagcucaaacaaaugcggaaccugauggcccaacaccagaacucgaagaagaaauguucaagaaaagaaauuuaacaauaauggaccuucauccagguagugguaaaacaagaaaauacuugccagcgauaguaagggaagcaauaaaaagaagacuacgaacacuaauauuagcaccaacaagaguagucgcagcagaaauggaagaagccuuaaaaggacuccccauaagguaccaaacaacagcaacaaaaagugaacacacgggaagggaaauaguugaccuaaugugucaugcuacauuuacaaugagauuacuaucaccuguaagagucccaaauuauaaucuaaucauaauggacgaagcacauuuuacagauccagcaucaauagcugcaagaggauacauuagcaccagaguaggaaugggugaagcagcagcaauuuucaugacggcaacgccacccgguacagcagacgcauuuccucaaucaaacgcaccuauacaagaugaagaaagggauauucccgaaagaucauggaacaguggaaaugaauggauaacagacuuugcaggaaaaacaguaugguucguaccaaguauuaaagcagguaacgacauugcuaauugucuacgcaaaaaugguaagaaaguaauacaacuaucaagaaaaacauuugauacugaauaucagaaaacuaaacuaaaugauugggauuuugucguuacaacagauauuucagaaaugggagcuaauuucaaagcagauagaguaauagauccaagacgaugccuaaaaccuguaauuuuaacagacgguccagaaagaguaauucuagcaggacccaugccaguuacagcagcuucagcagcacaaagaagaggaagaguaggaagaaauccacaaaaagaaaaugaccaauauauuuucacgggucaaccuuuaaacaaugaugaagaccaugcacauuggacagaagcaaaaauguuauuagauaauauaaauacaccugaaggaauaauaccagcauuauuugaaccugaaagagaaaaaucagcagcaauagauggagaauauagacuaaaaggagaaagccgaaaaacguucguggaacuaaugagaagaggagacuuaccaguaugguuagcacauaaaguagcgagugaaggaauaaaauacacagauaggaaaugguguuucgauggacaaagaaauaaucaaauacuugaagaaaauauggauguugaaaucuggacaaaagaaggagagaaaaagaaauuacgaccacguuggcuagacgcaagaacguauucagacccauuagcacuaaaagaauuuaaagaauuugcagccgggagaaaa

SEQ ID NO: 2277 - RNA, 2319 nt, Artificial Sequence
  derived and/or modified CDS sequence (opt6) from DENV-3 Consensus__C-prME
augaacaaccaaagaaagaaaacaggaaaaccauccauaaacauguuaaaaagaguaaggaaccguguaagcacaggaucacaacuagccaagcgauuuucuaagggacuauuaaauggucagggucccaugaaacucguaauggccuuuauugcauuucuacgcuuucuagcgauaccaccaacagcuggaguccuugcacgauggggaacuuuuaaaaaaucaggcgcaauuaaaguccucaaaggauuuaaaaaagaaauaucuaauauguuaucaauaauaaauaaacguaaaaaaaccagcuuaugucuuaugaugauauuaccggcggcacuugcauuccacuuaacuagucgagauggagaaccaagaaugauaguaggaaaaaaugaaagaggcaaaagcuuauuauuuaaaacugcaucaggaauaaauaugugcacauuaauagcaauggaucuuggagaaaugugugacgacacuguaacuuauaaauguccccauauaacggaaguugaaccagaagacauagauuguuggugcaacuugacaagcacaugggugacuuauggaacauguaaucaagcaggugaacauagaagagacaagagaagcguugcucuugcaccacauguagguauggguuuagauacaagaacacaaacuuggaugagcgcagaaggugcuuggagacaaguugagaaaguagaaacaugggcacuaagacaccccggauucacaauauuagcucuauucuuagcgcauuacauagggaccucgcuaacucaaaaaguaguaauauuuauauuacuaaugcuagugacaccuaguaugacuaugcgauguguaggaguaggaaauagagauuucguagaaggauuaaguggagcaacauggguugauguaguauuagaacauggaggguguguuacuacgauggcaaaaaacaaaccgacacuagacauagaauugcaaaaaaccgaagcaacacaacuggcaacucuuagaaaauuauguauagaagguaaaauaacaaacauaacaacugacucaagauguccaacacaaggcgaagcaacauuaccagaagagcaagaucaaaauuauguauguaaacacacuuauguagaucgaggcuggggaaaugggugcggccucuucggaaaaggcagcuuagugacaugugccaaauuucaaugucuagaaccuauagaaggaaaaguaguccaauacgaaaaccuaaaauauaccguaauuauaacaguacacacaggagaucaacaucaagucggaaaugaaacacaaggaguaacggcagaaauaacaccacaagcuuccaccacggaagcgauacugccagaauauggaacacuuggcuuagaauguaguccaagaacgggacuugauuucaacgaaaugauccuuuuaacuaugaaaaauaaagcauggaugguacauaggcaaugguuuuuugauuuaccucucccauggacaaguggggcaacgaccgaaacaccgacauggaacagaaaggaacuuuuaguaacauucaaaaaugcacaugcaaaaaaacaagaaguagugguacuaggaucacaagagggugcaaugcauacagcuuugacaggcgcaacagaaauacaaaauucaggaggaaccucgauauuugcaggacauuuaaaauguagacuaaaaauggauaaacuagaacuaaaagguaugucauaugccaugugcacaaauacauucguauuaaaaaaagaagucucugaaacgcaacacggcaccauacuaaucaaaguagaauacaagggagaagauguaccguguaaaauaccauucuccacagaagauggucaaggaaaagcacacaacgggagacugauaacugcaaacccaguaguaacaaaaaaagaagaaccuguaaauauagaagcagaaccaccauucggugaaagcaauauuguaauagggauaggagauaaugcauuaaaaauaaauugguacaaaaaaggaagcucuauuggaaaaauguuugaagcaacagcaagaggggccagaagaauggcaauacuaggugauacagcaugggauuuuggcagcguuggcggaguauuaaacucacuaggaaaaaugguacaucaaauauucggaucagcauauacggcacuuuuuucaggaguaaguugggucaugaaaauaggaauaggaguacuauuaacauggauaggacugaauaguaaaaauacuaguaugaguuuuucauguauagcaauaggaauuaucacguuauaccuaggagcgguagugcaagca

SEQ ID NO: 2278 - RNA, 45 nt, Artificial Sequence
  derived and/or modified CDS sequence (opt6) from DENV-3 Consensus__SSc
augacaucucuaugucuaaugaugauucuaccugcagcucuagcu

SEQ ID NO: 2279 - RNA, 57 nt, Artificial Sequence
  derived and/or modified CDS sequence (opt6) from DENV-3 Consensus__SSopt
augaaaagaaaaaaaacaucacuaugccuaaugaugauacuaccagcagcacuagca

SEQ ID NO: 2280 - RNA, 57 nt, Artificial Sequence
  derived and/or modified CDS sequence (opt6) from DENV-3 Consensus__SSm
augacacaaaaagucguaauauucauacuacuaaugcuaguaacaccaucaaugaca

SEQ ID NO: 2281 - RNA, 1482 nt, Artificial Sequence
  derived and/or modified CDS sequence (opt6) from DENV-3 Consensus__E
augagaugcguaggaguuggaaauagagacuucguagaaggauuaagcggggcaacauggguagacgugguauuagaacacggaggauguguaacaacgauggcaaaaaauaaaccaacauuagauauagaguuacaaaaaacagaagcaacacaacuagcaacauugaggaaauuaugcauagaaggaaaaauaacaaauauaaccacagauagcagaugcccuacccaaggugaagcaacauuaccagaagaacaagaccaaaauuauguauguaaacacacguacguagacagaggcuggggaaacggaugcggauuauuuggaaaagguaguuuaguaacaugcgcaaaauuucaauguuuagaaccaauagaagggaaagugguacaauaugaaaacuuaaaauauacaguaauaauaacaguacauacaggagaucaacaccaagugggaaacgaaacacaaggaguaacagcagaaauaacaccacaagcaucaacaacagaagcaauuuuaccugaauacgggacauuaggauuagaaugcuccccaaggacggggcuagacuuuaaugaaaugauacuauuaacaaugaaaaacaaagcuuggaugguucauaggcaaugguucuuugauuuaccauuaccauggacuaguggggcgacuacugaaaccccaacauggaauagaaaagaacuacuuguaacauuuaaaaacgcgcaugcgaaaaaacaagaaguaguagucuuaggaucacaagaaggagcaaugcauaccgcauuaacgggagcuacagaaauacaaaauucagggggaacaagcauauuugcaggacacuuaaaaugcagauuaaaaauggauaaauuagaauuaaaaggaaugagcuaugcaauguguacuaacacauucguacuaaaaaaagaaguaagugaaacucaacauggaacaauacuaauaaaagucgaauauaaaggagaagacguaccauguaaaauaccauuuagcaccgaagacggacagggaaaagcacauaacggaagacuaauaaccgcaaauccaguaguaacaaagaaagaggaaccaguaaacauagaagcagaaccaccauuuggugaaagcaacauaguaauaggaauaggagacaacgcauuaaaaauaaacugguauaaaaaaggaucaaguauagguaaaauguucgaagcaacagcaagaggagcaagaaggauggcaauacuaggagauacagcaugggauuuuggaucagucggaggagugcuaaauucauuagguaaaaugguacaccaaauauucggaagugcauacacagcuuuauuuucaggaguaucaugggucaugaaaauagguauaggaguguuauuaacauggauaggacuaaauaguaaaaauacaaguaugaguuuuucguguauagcaaucggaauuauaacacuauaucuaggugcaguaguucaagcauaa

SEQ ID NO: 2282 - RNA, 1176 nt, Artificial Sequence
  derived and/or modified CDS sequence (opt6) from DENV-3 Consensus__EdelTM-variant (aa1-392)
augagaugcgucggaguaggaaauagagacuuuguagaaggauuaucaggagcaacauggguagacguaguauuagaacauggcggaugcguaacaacaauggcaaaaaacaaaccaacacucgacauagaacuacaaaaaacagaagcaacacaauuagcaacacuaagaaaauuauguauagaaggaaaaaucacuaacauaacaacagacagcagaugcccaacacaaggagaagcaacauuaccagaagaacaagaccaaaacuacguauguaaacacaccuacguagaccgagguuggggaaauggauguggccucuucggaaaaggaucacuuguaacaugcgcaaaauuccaaugucuagaaccaauagaaggaaaaguaguacaauacgagaaccuaaaauacacaguaauaauaacaguacacacaggagaccaacaucaaguaggaaacgaaacacaaggaguuacagcagaaauaacaccacaagcaagcacaacagaagcuauacucccagaauauggaacccuaggacuagaauguucaccaagaacaggacuagauuucaacgaaaugauacuauuaacaaugaaaaacaaagcauggaugguccacagacaaugguucuuugaccuaccauuaccauggacaagcggagcaacaacagagaccccaacauggaacagaaaagaacuuuuaguaacauuuaaaaacgcacaugcaaaaaaacaagaaguuguaguacuaggaucucaagaaggugcaaugcauacugcauuaacuggagcaaccgaaauacaaaacucgggaggaacaaguauauucgcaggacaccuaaaauguagacuaaaaauggauaaacuagaacuaaaaggaaugagcuaugcaaugugcacaaauacauucguucucaaaaaagaaguaucagaaacacaacaugguacaauauuaauaaaaguagaauacaaaggagaagacguaccaugcaaaaucccauucucaacagaagauggccaaggcaaagcacacaacggacgacuaauaacagccaacccaguaguaacaaaaaaagaagaaccagucaauauugaagcagaaccaccauucggcgaaucaaauauaguaauaggcauaggagacaacgcauuaaaaauaaacugguacaaaaaa

SEQ ID NO: 2283 - RNA, 1269 nt, Artificial Sequence
  derived and/or modified CDS sequence (opt6) from DENV-3 Consensus__EdelTM-variant (aa1-422)
augagaugcgugggaguaggaaacagagacuucguagaaggacuaucuggagccacauggguagacguaguauuagaacauggaggaugcguaacaacaauggcuaaaaauaaaccaacuuuagauauagaacuacaaaaaaccgaagcaacacaauuagcaacacuaagaaaacuauguauagaaggaaaaauaacaaauauaacaacugacuccagauguccaacacaaggcgaagcaacacuaccagaagaacaagaucaaaauuacguaugcaaacacacauauguagacagaggauggggaaacggauguggcuuauucggaaaaggaucauuaguaacaugugcaaaauuucaaugcuuagaaccaauagaaggaaaagucguacaauacgaaaaccuaaaauacacagucauaauaacaguacauacaggggaccaacaccagguaggaaaugaaacacaaggaguaacagcagaaauaacaccccaagccaguacaacagaagcuauacuacccgaauacggcaccuuaggauuagaauguuccccaagaacaggccuagacuuuaacgaaaugauauuacuaacaaugaaaaauaaagccuggaugguacacagacaaugguuuuuugaccuaccauuacccuggaccucaggagcaacaacagaaacaccaacuuggaacagaaaagaacuauuaguuacauuuaaaaacgcacacgcaaaaaaacaagaaguaguaguauuaggaucacaagaaggagcaaugcauacagcauuaacaggagcaacagaaauacaaaauucaggaggaacaaguauauuugcaggacauuuaaaaugcagacuaaaaauggauaaauuagaauuaaaagguaugagcuacgcaauguguacaaauaccuuuguacuaaagaaagaaguaagcgaaacacaacacggcacaauauugauaaaagucgaauauaaaggcgaagacguaccaugcaagauacccuuuaguacagaagauggacaagguaaagcacauaauggacgauuaauaaccgccaacccaguaguaacaaaaaaagaagaacccguaaauauagaagcagaaccaccauucggagaaucaaacauaguaauaggcauaggugacaacgcauuaaaaauaaacugguauaaaaaaggaaguaguauaggaaaaauguuugaagcaacagcaagaggugcacgaaggauggcaauuuuaggagacacagccugggacuucggaaguuaa

SEQ ID NO: 2284 - RNA, 1260 nt, Artificial Sequence
  derived and/or modified CDS sequence (opt6) from DENV-3 Consensus__EdelTM-variant (aa1-419)
augcguuguguugggguuggaaauagagauuuugucgaaggauuaagcggagcaacauggguagacguaguacuagaacaugggggguguguuaccacaauggcaaaaaauaaaccaacacuagauauugaacuacaaaaaacagaagccacacaacuagcuacauuaagaaaacuaugcauagagggaaaaauaacaaauauaacaacugacaguagaugcccaacccaaggggaagcaacacucccagaagaacaagaucaaaauuacguaugcaaacacacguacguggacagaggauggggaaacggauguggauuauucggaaaaggaagcuuaguuacaugcgcaaaauuucaaugccuagaaccaauagaaggaaaaguaguacaauaugaaaaucuaaaauauacaguaauaauaacaguacauacaggagaucaacaucaaguaggaaacgaaacacaaggaguuacagcagaaauaacaccccaagcaucaacaacagaggcaauauuaccagaguacgguacauuaggacuagaauguucaccaagaacaggauuagauuuuaacgaaaugauauuauugacaaugaaaaauaaagcauggaugguacaccgacaaugguuuuucgaccuaccauuaccauggacgagcggagcaacgacagaaacaccaacauggaauagaaaagaacucuuaguaacauuuaaaaacgcacacgcuaaaaagcaagaagucguaguauuaggaucacaagaaggagcaaugcacacagcauuaacaggagcaacugaaauacaaaacucaggaggaacaucgauauuugccggacauuuaaaauguagacuaaaaauggacaaauuagaguuaaaaggaaugagcuaugcaaugugcacaaauacguucguacuaaaaaaagaaguaucagaaacgcaacauggaacgauauuaauaaaaguagaauacaaaggagaagacguaccauguaaaauuccauucaguacagaagauggccaagguaaagcucacaacggaagacuaauaacagccaauccaguaguaacuaaaaaggaagaaccaguaaacauagaagcagaaccucccuuuggagaaagcaacauuguaauaggaauuggagacaaugcauuaaaaauaaacugguacaaaaaagguagcucaauaggaaaaauguucgaagcaacggcaagaggcgcuagaaggauggcaauauuaggagauacagcaugggauuaa

SEQ ID NO: 2285 - RNA, 1155 nt, Artificial Sequence
  derived and/or modified CDS sequence (opt6) from DENV-3 Consensus__Edelaa101-107
augagaugcgucggaguaggaaauagagauuucguagaaggauuaucaggagcaacauggguagacguaguacuagaacacggaggauguguaacaacuauggccaaaaacaaaccaaccuuagacauagaacuacaaaaaacugaagcaacucaacuagcaacauuaagaaaacuaugcauagaagguaaaauaacaaacauaacaacagacagcagaugcccaacacaaggagaagcaacauuaccagaagaacaagaccaaaacuacguauguaaacauacauauguagauagaggauucggaaaaggaucauuaguaacaugugcuaaauuucaauguuuagaaccaauugagggaaaaguaguacaauacgaaaaccuaaaauauacaguaauaauuacaguacacacaggcgaccaacaccaaguaggaaacgaaacacaaggaguaacagcugaaauaacaccacaagcgucaacaacagaagcaauacuacccgaauacggaacacuaggauuagaauguagcccuagaacaggauuagacuucaaugaaaugauauuacuaacaaugaaaaacaaagcauggaugguucacagacaaugguucuuugauuuaccacucccauggacaucaggagcuaccacagaaacaccaaccuggaaucguaaagaacuauuaguaacauucaaaaacgcccacgcaaaaaaacaagaagugguugucuuaggaucacaagaaggagcaaugcauacagcacuaacaggagcgacagaaauacaaaacucaggaggaacaaguauauucgccggacaccuaaaauguagauuaaaaauggacaaacuagaacuaaaaggaaugagcuacgcaaugugcacaaacacauucguucuaaaaaaagaaguaagugaaacccaacauggaacuauacuaauaaaaguagaauacaaaggagaagacgugccauguaaaauaccauuuagcacagaagacggacaagguaaagcacacaacggcagauuaauaacagcaaauccaguaguaacaaaaaaagaagaaccaguaaacauagaagcagaaccaccauucggagaaucaaacauaguaauaggaauaggagacaaugcauuaaaaauaaacugguauaaaaaa

SEQ ID NO: 2286 - RNA, 1173 nt, Artificial Sequence
  derived and/or modified CDS sequence (opt6) from DENV-3 Consensus__EdelTM-variant (aa1-391)
augagauguguaggaguaggaaacagagacuucguagaaggacuaaguggagcaacaugggucgacguaguacuagaacauggaggaugcguaacaacaauggcuaaaaacaaaccaacacuagauauagagcuacaaaaaaccgaagcaacacaacuagcaacacucagaaaauuaugcauagaaggaaaaauaacaaacauaacaacagauaguagaugccccacucaaggagaagcuacacuaccagaagaacaagaucaaaacuacguauguaaacacacauaugucgacagaggauggggaaacggauguggacuauucggaaaaggaagccuagucacaugcgcaaaauuucaaugcuuagaaccaauagaaggaaaaguuguacaauaugaaaaccugaaguacacaguaaucauaacaguacacaccggagaccaacaucaaguaggaaacgaaacacaaggaguaacagccgaaauuacaccacaagcaucaaccaccgaagccauacuaccagaauacgguaccuuaggacuagaauguaguccaagaacaggauuagauuuuaaugaaaugauauuauuaacaaugaaaaacaaagcauggaugguacacagacaaugguucuuugaccuaccacuaccauggacaaguggagcaacaacagaaacaccaaccuggaacagaaaagaacuauuaguaacauuuaaaaacgcacacgcaaaaaaacaagaaguaguaguacuaggaagccaagaaggugcaaugcacaccgcacuuacaggagcaacagaaauucaaaacucaggaggaacaagcauauucgcaggacaccuaaaaugucgacuaaaaauggacaaauuagaacuaaaagguaugucauaugcaaugugcacaaacacauucguucuaaaaaaagaaguuagcgaaacacaacauggaacaauacugauaaaaguagaauauaaaggugaagacguacccugcaaaauaccauucagcacagaagacggccaaggaaaagcacacaacggaaggcuaaucacagcaaacccaguaguaacaaaaaaagaagaaccagucaauauugaagcagaaccacccuucggugaaucaaacauaguaauaggaauaggagacaacgcacuaaaaauaaacugguacaaa

SEQ ID NO: 2287 - RNA, 2025 nt, Artificial Sequence
  derived and/or modified CDS sequence (opt6) from DENV-3 Consensus__SSc-prME
augacaagcuuaugccugaugaugauacuaccugcggccuuagcauuucaucuaacaucacgagauggagaaccuagaaugauaguagggaaaaaugaaagaggaaaaagucuauuauuuaaaacagcaucgggaauaaauaugugcacacuaauagccauggacuuaggcgaaaugugcgaugauacaguaacuuacaaaugcccacacauaacagaaguagaaccggaagauauagacuguuggugcaauuuaacuaguacauggguaacauauggaacaugcaaucaagcaggagaacauaggagagacaaaagaagcguagcuuuagcuccacacguuggaaugggacuagacacucgaacacaaacauggaugagugcagaaggagcauggagacaaguagaaaaaguagaaacaugggcucuuagacacccaggauuuaccauuuuagcguuauuuuuagcacauuacauuggaacauccuuaacacaaaaaguugugauuuuuauauuauuaaugcuagugacaccaagcaugacuaugagauguguaggaguaggaaauagagauuuuguugaaggucuaagcggagcaacauggguagaugugguuuuagaacauggaggauguguaacaacaauggcaaaaaacaaaccaacucuagacauagaacuacaaaaaaccgaagcuacacaauuagcaacacuaaggaaacuguguauagaagguaaaauaacgaacauaacaacagauagucgauguccaacacagggagaagcuacacugccagaagaacaagaucaaaauuauguaugcaaacauacuuacguugauagaggauggggcaauggauguggauuauuuggaaaaggaagucuaguaacaugugcuaaauuucaaugccucgaaccaauagaaggcaaaguaguccaguaugaaaaucuaaaauacacaguaauaauaacuguacauacaggagaucaacaucaaguaggaaacgaaacacaaggaguuaccgcagaaauaacgccacaagccaguaccacagaagcaauacuaccugaauauggaacacuaggucuggaaugcucaccaagaacaggucuagauuuuaaugaaaugauacuauugacuaugaaaaauaaggcguggaugguacauagacaaugguuuuuugacuuaccacuaccauggacgagcggugcaacaacagaaacaccuacauggaauaggaaagaacucuuaguuacauuuaaaaacgcacaugcaaaaaaacaggaaguaguaguauugggaucacaagaaggagcuaugcauacagcauuaacaggagcgaccgaaauccaaaacucuggagguacgaguauauucgcaggacauuuaaaaugcagauuaaaaauggacaaacucgaauuaaaaggaaugagcuacgcgauguguacaaauacauuuguauugaaaaaagaaguaucggaaacacaacauggcacuauuuuaauaaaaguugaauauaaaggggaagauguuccauguaaaauaccuuuuagcacagaagacggucaaggaaaagcccauaacggaagacuaauaacagcaaacccaguagugacaaaaaaggaagaaccaguaaacauagaagcagaaccaccauuuggagaaucuaauaucguaauaggaauuggagacaacgcacugaaaauaaauugguauaaaaaaggaaguucaauagguaaaauguuugaagcaacugcucgaggugcgcgaagaauggcaauccuaggagacacugcgugggauuuugggagcguaggagguguauugaacaguuugggaaaaaugguacaucaaauauuuggaucagcuuauacggcauuauuuucugguguaagcuggguuaugaaaaucggaaucggagucuuacuaacauggaucggauuaaauaguaaaaauacaaguaugaguuuuuccugcauagcaauagguauaauaacacuauacuuaggugcagucguacaagcuuaa

SEQ ID NO: 2288 - RNA, 2025 nt, Artificial Sequence
  derived and/or modified CDS sequence (opt6) from DENV-3 Consensus__SSc-prME(F108S)
augacaucauuaugcuuaaugaugauuuuacccgcagcacuagccuuucaucuaacaagucgagacggagaaccaagaaugaucguaggaaaaaaugaaagagguaaaucauuacuauucaaaacagcuucuggaauaaacauguguacauuaauugcuauggaucuaggagaaaugugugacgacacagugaccuacaaaugcccccauauaacagaaguagaaccagaagauauagauuguugguguaauuuaacaaguacguggguuacuuauggaacauguaaucaagcaggcgaacacaggagggauaaaagaucaguagcacuagcuccucaugugggaaugggucuagauacaagaacacaaacuuggaugagcgcagaaggggcuuggaggcaaguagaaaaaguagaaacaugggcauuacgacauccuggauucacaauuuuagcacuguuccuagcgcauuauaucggaaccucacuuacacaaaaaguaguaauuuucauauuacuuauguuaguaacaccaaguaugacuaugagauguguugggguugggaacagagauuuugucgaaggauuaaguggcgcaacuuggguagauguaguacuugaacauggcggauguguuacaacaauggcaaaaaauaaaccaacuuuagauauagaauuacaaaaaacagaagcaacacaauuagcaacuuuaagaaaacuauguauagaagguaaaauaacuaacaucacaaccgacaguagauguccuacacaaggagaggcaacauuaccagaagaacaagaucaaaauuacguguguaaacauacguacguggauagaggauggggaaaugguugcggacuuagcggaaagggauccuuaguuacaugcgcaaaauuucaaugucuagaaccuauagaaggaaaaguaguccaauacgaaaauuuaaaauauaccguaauuaucacuguacauacaggcgaccaacaucaaguaggaaaugagacacaaggcguaacagccgagauaacaccacaagccaguaccacagaagcaauucuaccugaauacggaacacugggauuagaauguucaccucgaacuggacucgacuuuaaugagaugauauuauuaacaaugaaaaauaaagcuuggaugguacauagacaaugguuuuucgauuuaccacuaccauggacaaguggugcaacaacugaaacaccgacauggaauagaaaagaacuauuaguuacauuuaaaaaugcucaugcuaaaaaacaagaaguaguuguacuaggaucgcaagagggagcaaugcauacagcacuuacaggagcaaccgaaauacaaaacucuggaggaacaaguauauuugcaggacauuuaaaauguagauugaaaauggauaaauuagaacuuaaaggaaugagcuacgcuaugugcacaaauacuuuuguuuuaaaaaaagaaguaucagaaacacaacacggaacaauacuaauaaaaguggaauauaaaggagaagauguaccauguaaaauuccauuuagcacagaagauggucagggaaaagcacacaacggaagauuaauaacagcuaaucccguaguaacaaagaaagaagaacccgucaauaucgaagcagaaccaccauuuggagaaagcaauauuguaauagguauaggagauaaugcauuaaaaauaaauugguacaaaaaaggauccucaauuggaaaaauguuugaggcaacagcuagaggagcaagaagaauggcaauuuuaggcgacacugcuugggacuuuggaagcguuggaggaguacuaaauucacuaggaaaaaugguacaucaaauauuuggaucugcauacacggcacuguuuucuggaguuagcugggucaugaaaauuggaauagguguacuauuaaccuggauaggauuaaauaguaaaaauacuucuaugucauuuagcuguauagcuauuggaauaauaacacuauaucuaggugcaguaguucaagcauaa

SEQ ID NO: 2289 - RNA, 2025 nt, Artificial Sequence
  derived and/or modified CDS sequence (opt6) from DENV-3 Consensus__SSc-prME(R186L)
augaccagcuuauguuuaaugaugaucuuaccugccgcuuuagcauuucaucuaacaucaagagacggcgaacccagaaugauaguagggaaaaaugaaagaggcaaaagcuuguuauuuaaaacagcuaguggaauaaauaugugcacacuaauagcaauggaucuaggagagaugugugaugauacaguaacauauaaauguccacauauaacggaaguagaaccagaagauauagauuguugguguaauuugaccagcacaugggugacuuacggaacuuguaaccaagcuggagaacauagaagagauaaaagaagcguagcauuggcuccacacguaggaaugggacuugauacacggacacaaacuuggaugucugcagaaggagcauggagacagguagaaaaaguagaaacaugggcauuaagacauccuggauuuaccauacuagcacucuucuuagcccauuauauuggaaccuccuuaacgcagaaaguggugaucuuuauacuacuaaugcuaguuacaccaaguaugacaaugagauguguaggaguagggaauagagauuuuguugaaggauuaagcggagcaacguggguagacguaguuuuagaacacggagguuguguuacaacaauggcaaaaaacaaaccaacuuuagauauagaacuacaaaaaacagaagccacacaauuggcaacauuaaggaaacuguguauugaagggaaaauaacaaacauaacaaccgauagcagaugcccgacacaaggagaagcaacguuaccagaagaacaagaucaaaauuacguauguaagcauacuuacguugauagaggauggggaaauggauguggacuauucggaaagggaagucuuguuacgugcgccaaauuccaauguuuggaacccauagaagguaaaguaguacaguaugaaaauuuaaaauauaccguaauuauaacaguacauacaggagaucaacaucaaguuggaaaugaaacucaagguguaacugcagagauaacaccccaagcaucaaccacagaagcuauauuacccgaauauggaacucuuggacuagaguguaguccauuaacagguuuagauuucaaugaaaugauauuacuaacaaugaaaaauaaagcauggaugguacauagacaaugguuuuucgauuugccauuaccauggacaucaggagcuacaacagaaaccccuacauggaauagaaaagaacuauuaguaacauucaaaaacgcucaugcaaaaaaacaagaaguaguaguauuaggaucacaagaaggagcaaugcauaccgcauuaacaggugcaacagaaauacaaaacucaggagguacaucaauauuugcaggacaucuaaaauguagauuaaaaauggauaaacuagaauuaaaagguaugaguuaugcaaugugcacaaauacauuuguacuaaaaaaagaagucucagaaacacaacaugguacaauacuaauaaaaguagaauauaaaggagaagacguaccuugcaaaauaccauuuuccaccgaagacggacaaggaaaagcacauaacggaagauuaauaacugcaaacccuguagucacaaaaaaagaagagccaguuaauaucgaagcggaaccgccauuuggagagucuaauauaguuauaggaauaggagauaacgcccuaaagauaaauugguacaaaaaagguaguaguauaggaaaaauguuugaggcaacagcuagaggagcacgaagaauggcaauauugggugauacagcgugggauuuuggaagcguuggcggaguauuaaauucacucggaaaaaugguacaucaaauauuugguagugcauauacagcauuauuuaguggaguaucauggguaaugaaaauagguauaggagucuuauugacuuggaucggacuaaauagcaaaaauacaucaaugagcuucaguuguauagcuauagggauuauaacauuauaucuaggugcgguaguacaagcauag

SEQ ID NO: 2290 - RNA, 2025 nt, Artificial Sequence
  derived and/or modified CDS sequence (opt6) from DENV-3 Consensus__SSc-prME(A265T)
augacaagucuguguuuaaugaugaucuuaccagcagcauuagcauuucauuuaacaucaagagauggagaaccaagaaugauaguuggaaaaaaugaaagagguaaaaguuuauuauucaaaacagcaucugguauaaauaugugcacauuaauugcaauggaucuaggagaaaugugcgaugacacaguaacauauaaauguccccauauaacagaaguugaaccagaagauauagacugcuggugcaacuuaacauccacguggguaaccuacggaacuuguaaucaagcuggagaacauagaagagauaaaagaaguguagcacuugcaccacacgucgguaugggacuagacacaagaacacaaacauggaugagcgcugaaggcgcauggcgacaaguugaaaaaguagaaacaugggcgcuaagacacccuggauuuacaauauuagcauuauuucuagcacauuauauaggaacaucacugacucaaaaaguuguaauauucauucuuuuaauguuaguaacaccuaguaugacuaugcgguguguuggagucggaaauagagacuucguagaaggccuaagcggagcaacauggguggauguagucuuagaacauggcggaugcgucacuacgauggcgaaaaauaaaccaacccuagacauagaauuacaaaaaacagaagcuacgcaacucgcgacauuacgaaaacuguguauagaaggcaagauaacaaauauaacaacagacucaagauguccaacacagggugaagcaacauuaccagaagaacaagaucaaaacuacguuugcaaacauacauacguagauagaggauggggaaauggaugcgguuuauuugggaaaggauccuuaguuacaugugcgaaauuucaaugcuuagaaccaauagaaggaaaaguugugcaauaugagaacuuaaaauauacagucauaauaacaguacauacaggagaucaacaucagguaggaaaugagacacaaggaguaacagccgaaauaacaccacaagcaucaacaacugaagcgauauuaccagaauacggaacguugggacuagaauguagcccaagaacaggacuagacuucaacgaaaugauauuacuuacaaugaaaaauaaagcauggaugguacauagacaaugguuuuuugauuuaccacuaccauggacaaguggcgcaacaacagaaacuccaacauggaacagaaaagagcuauuagucacguuuaaaaacgcacaugccaaaaaacaagaagucguaguccuagguucacaagaaggugcaaugcauacugcacuuacgggaacgacagaaauacaaaauaguggaggaacaucaauauucgcaggacauuugaaaugcagauuaaaaauggacaaacuagaauuaaaaggaaugaguuaugcaauguguacaaacacauuuguauuaaaaaaagaaguaucagaaacccaacacggaacaauccuaaucaaaguagaauauaaaggagaagauguaccuuguaaaauaccauuuucaacagaagauggacaagguaaagcacacaacgggcguuuaauaacagcaaacccaguuguaacaaaaaaagaagaacccguaaauauagaagccgaaccgccauuuggagaaagcaacauaguuauaggaauaggagacaaugcacucaaaauaaauugguauaagaaagggucaucaauagguaaaauguucgaagcaacagcuaggggugcaaggagaauggcaauuuuaggugacacagcaugggauuuuggaagcguagguggaguauuaaacucacugggaaaaaugguacaucaaaucuuugguucagcauauaccgcuuuauuuucuggugucucguggguaaugaagauaggaauaggaguauuauuaacauggauaggauuaaauaguaaaaacacaaguaugaguuucaguuguauagcaauagguauaaucacucuauacuuaggagcaguaguacaagcauaa

SEQ ID NO: 2291 - RNA, 2025 nt, Artificial Sequence
  derived and/or modified CDS sequence (opt6) from DENV-3 Consensus__SSc-prMEdelstem_TM-JEV
augacaucuuuaugcuuaaugaugauuuugccagcggcacuggcauuucauuuaacaaguagagauggagaaccaagaaugauaguaggcaaaaaugaacguggaaaaucccuacuuuuuaaaacugcaucaggaauuaacaugugcacacuuauagcaauggacuugggagaaaugugugacgauacaguaacauauaaauguccucauauaacugaaguagaaccagaagauauagacuguugguguaaucuuacaagcacauggguaacauauggaacaugcaaccaagcaggagaacacagaagagacaaaagaaguguagcauuggcuccucauguagguaugggacuggacacaagaacgcaaacauggaugucagcagaaggggcauggagacaagucgaaaaaguggaaacuugggcacuaaggcauccaggauuuacaauuuuagcauuauuuuuagcacacuauauaggaacaucauuaacacaaaaaguagucauauuuauccuauugauguuaguaacuccaucuaugacaaugagauguguaggcguuggaaacagagauuuuguagaaggucuaagcggagcaacauggguugauguaguccuagaacacggcggaugcguaacuaccauggcuaaaaauaaaccaacuuuagauauagaauuacagaaaacugaagcaacacaacuggcaacauuaagaaaauuauguauagaagguaagauaacuaacauaacaacugacucaagaugcccaacacaaggagaagcaacucuaccagaagaacaagaccaaaacuacguauguaagcacacguacguagaucgaggauggggaaauggaugcggcuuauuugguaaagguagucuagucacaugugcaaaauuucaauguuuagaaccuauagaaggaaaaguaguacaauaugaaaaucugaaauauacaguuauaauaacaguacacacaggagaucaacaucaaguugguaaugaaacacaaggaguuacagcugaaauaacaccccaagcaucaacaacagaggcaauacuaccagaauauggaacguuaggucuugaauguaguccacgaacugguuuggauuuuaacgaaaugauacucuuaacuaugaaaaacaaagcauggaugguacauagacaaugguucuuugaccuaccauuaccauggacaaguggcgccacuacugaaacacccacauggaauagaaaagaauuauugguaacuuucaaaaacgcacaugcaaagaaacaagaaguuguaguauuaggaucacaagagggcgcuaugcacacggcacuaacaggagcgacagaaauacaaaauuccggaggaacuagcauauuugcagggcauuuaaaauguagauuaaaaauggacaaacuagaauuaaaaggaaugucauaugcuauguguaccaauacauucguacucaagaaagaaguuucagaaacgcaacauggcacaauauuaauuaaagucgaauacaaaggagaagauguaccauguaaaauuccauuuucaacagaagacggucaaggaaaagcacauaauggaagauuaaucacagcaaacccaguaguaacaaagaaagaagaaccaguuaauauagaagcagaaccaccauuuggagaaagcaauauaguaauaggaauuggagacaaugcauuaaaaauaaacugguauaagaaaggaucaacauuaggaaaagcauuuaguacuacauuaaaaggagcgcaaagguuagcagcauuaggagauacugcuugggauuuugguucuauagguggaguuuuuaacucaaucgggagagcaguacaucagguauuuggaggggcauuuagaacuuuauuuggaggcaugucauggauuacucaaggacuaaugggugcauuguugcuuuggaugggaguaaacgcuagagauaggaguauugcauuggcauuucuugcaacugguggaguauuaguauuuuuagcuacaaauguacaugcguaa

SEQ ID NO: 2292 - RNA, 1326 nt, Artificial Sequence
  derived and/or modified CDS sequence (opt6) from DENV-3 Consensus__SSm-EdelTM
augacacaaaaagucguaaucuucauacuacuaaugcuaguaacaccauccaugacuaugagaugcguagguguaggaaaucgagacuuuguagaaggauuaucaggcgcaacauggguagacguaguacucgaacauggaggaugcguaacgacaauggcaaaaaauaaaccaacccuggacauagaauuacaaaaaaccgaagcaacccaauuagcaacacuacgaaaauuaugcauagaggggaaaauaacaaauauaacaacagacucaagauguccaacacaaggcgaagccacacuuccagaagaacaagaccaaaauuacguaugcaaacacacauauguagacagaggauggggaaacggcugcggacuauucgggaaaggaagcuuaguaacaugugcaaaauuucaauguuuagaaccaauagaaggaaaaguaguacaauaugaaaaccuaaaauauacaguaauaauaacaguacacacaggcgaccaacaccaaguaggaaacgaaacacaagguguaacagcagaaauaacaccacaagcaucaaccaccgaagcaauacuuccagaauauggaacacuaggccuagaaugcucuccaagaacaggauuagacuuuaacgaaaugauuuuauuaaccaugaaaaauaaagccuggaugguucaccgacaaugguucuuugaccuaccucuuccauggacauccggagcaaccacagaaaccccaacauggaacagaaaagaauuauuaguaacauucaaaaaugcacacgccaaaaaacaagaaguaguaguacuaggcucacaagaaggagcaaugcacacagcuuuaacaggagccacagaaauacaaaacucuggaggcacaucaauauucgcaggacaccuaaaauguagauuaaagauggacaaacuagaacuaaaaggaaugucauaugcaauguguacaaauacauuuguacucaaaaaagaaguaucagaaacacaacauggaacgauauuaauuaaaguagaauacaaaggagaagacguaccuugcaaaauaccauucucaacagaagacggacaaggaaaagcccacaacggaagacuaaucacagcaaauccaguaguaacuaaaaaagaagaaccaguaaacauagaagcagaaccaccauucggugaaucaaauauaguaauaggaauaggagauaaugcauuaaaaaucaauugguauaaaaaagguagcucaauuggaaaaauguuugaggcaacagccagaggugcgagaagaauggcaauacuaggugauacagcuugggauuucggaucauaa

SEQ ID NO: 2293 - RNA, 2373 nt, Artificial Sequence
  derived and/or modified CDS sequence (opt6) from DENV-3 Consensus__C-P2A-SSc-prME
augaauaaucaaagaaagaaaacgggcaaaccaaguauaaauauguugaaaaggguaagaaacagaguaucaaccggcagucaacuagcaaagagauuuucaaaaggacuuuuaaacggacagggaccaaugaaacuaguaauggcauucauagcauuucuaagguuucuagcaauaccgccuacagcgggaguauuagcaagauggggaacuuucaaaaaaagcggagcaauuaaaguacuuaaaggcuuuaaaaaagaaauaagcaauaugcuaaguauaauaaauaaaagaaaaaaaaauuuugaccuacugaaauuagcaggagaugucgaaagcaaucccgggccaacaagcuuaugcuuaaugaugauacugccagcagcucuugcauuucacuuaaccucaagagacggcgaaccacggaugauuguaggaaaaaacgaaagaggaaaaagccuacuuuuuaaaacagcaagcggaauaaauaugugcacucuaauagccauggaccuaggugaaaugugugaugacacaguuacauauaaaugcccacauauuaccgaaguugaaccagaagacauagauuguugguguaauuuaacaaguacauggguaacauauggaaccuguaaucaagcaggagaacauagaagagacaaaagaucaguggcauuagcaccacacgugggaaugggacuagauacucgaacccaaacuuggauguccgcagaaggagcguggagacaagucgaaaaaguagagacaugggcacuaagacacccaggguucacaauauuagcauuguucuuagcccauuacaucgguacuucucucacacaaaaaguaguaauauuuauacuucucaugcuggucacaccuagcaugacuaugagauguguaggcguuggaaaccgagacuuuguagaaggauuaagcggagcaaccuggguagaugucguacucgagcacggagguuguguaacaacaauggcaaaaaauaaaccaacauuggauauugaauuacaaaaaacagaagcuacacaguuggcgacucuacgaaaacuuuguauugaaggaaaaauaacaaacauuacaacagauaguagauguccuacacaaggugaagcaacauuaccagaagaacaagaccagaacuaugucuguaaacauacauacguagauaggggauggggaaaugguuguggcuuauuuggaaaagguucauuaguuacaugugcaaaauuccagugcuuagaaccaauagaaggaaaaguaguacaauacgaaaauuuaaaauauacaguuauaauaaccguccauacuggagaucaacaucaaguaggaaacgaaacccaaggcguaacagcggaaauaacaccacaagccagcacuacagaagcuauucucccggaauacggaacauugggacucgaauguucaccacgaacuggguuggauuuuaacgaaaugauucuauuaacgaugaaaaauaaggcauggaugguacacagacaaugguucuuugaucuaccccuaccuuggacaaguggggcuacaacagaaacaccgacauggaaucgcaaagaauuauuaguuacauuuaaaaacgcacaugcaaaaaaacaagaaguaguaguacuagguagccaagaaggggcaaugcacacagcucuaacaggcgcaacagagauacaaaacagugggggaacaucaauauucgcuggucacuuaaaauguagauuaaaaauggauaaacuugaacuaaaaggaaugagcuaugcaaugugcacaaacacguucguuuuaaaaaaagaaguaagcgaaacucaacacgggaccauauuaauuaaaguagaauacaaaggagaagauguuccuugcaaaauaccauuuucaacagaagacggacaaggaaaagcacauaauggacgguuaauaacagcaaacccaguagugacuaaaaaagaagaaccuguaaauauagaagcugaaccaccguucggagaaaguaauauaguuauuggaauaggagauaacgcacuaaagaucaacugguacaaaaaaggaaguucaauugguaaaauguucgaagcuacugcacgaggggcaagacguauggcaauacuaggcgacacagcaugggauuuugggucaguaggaggcguauuaaacagucuaggaaaaaugguucaccaaaucuucggaagugcauauacugcauuguuuucaggaguaucauggguuaugaaaauuggaauagguguucuauugacauggauuggauuaaauaguaaaaacacaaguaugagcuuuaguugcaucgcaaucggaauaauaacacuauaucuaggggcaguagugcaagcuuga

SEQ ID NO: 2294 - RNA, 2037 nt, Artificial Sequence
  derived and/or modified CDS sequence (opt6) from DENV-3 Consensus__SSopt-prME
augaaaagaaagaaaacuucguuauguuuaaugaugauauuaccagcagcuuuagcuuuucacuuaacuucaagagacggagaaccuagaaugauaguaggaaaaaaugaaagaggaaaaaguuugcuauuuaaaacagcaucaggcaucaacaugugcacgcuaauagcaauggauuuaggugaaaugugugacgauacuguaacuuacaaaugcccacauauaacagaaguugaaccagaagauaucgacuguugguguaauuuaacaagcacauggguaacauauggaacuugcaaucaagcaggagaacauagaagagauaaaagaucaguagcauuagcaccacauguugguaugggauuagauacaagaacacaaacauggaugagugcagaaggagcuuggagacaaguagagaaaguagaaacaugggcacuacgacauccaggauucacaauacuagcacuuuuuuuagcacauuacauaggaacgagccugacacaaaaaguaguaauuuuuauacuguuaaugcuaguuacaccaaguaugacuaugagauguguggguguuggaaacagagauuuugucgaaggauuaagcggagccacauggguagacgugguauuagaacauggaggauguguuacuacuauggcuaaaaauaaaccgacacuagacauagaauuacaaaaaacagaggcaacacaacuagcuacauuaagaaaauuauguauagaaggaaaaauaaccaauauuacaaccgauagcagauguccaacacagggagaagccacuuuaccagaagaacaagaucaaaauuacguuugcaaacacacauauguggauagaggauggggaaacggaugcgggcuauuuggaaaaggaucauuaguuacaugcgcaaaauuccaaugucuagaaccaauagaaggaaaaguuguucaauaugaaaaucuaaaauauacaguaauaauaacaguccauacaggggaccaacaucaaguuggaaaugaaacacaggguguaacagcugaaauaacaccucaagcuaguacuacagaggcgauacuaccagaauauggaacauuaggacuagaauguucgccaagaacagguuuggacuuuaacgaaaugauauuacuaacaaugaaaaauaaagcauggaugguacacagacaaugguucuucgaccucccacuaccauggacaagcggcgcaaccacagaaacaccuacauggaaccgaaaagaacuacuaguaacauucaaaaaugcucaugcaaaaaagcaagaaguaguaguucuugguucucaagaaggcgcaaugcauacagcacucacaggagcgacugaaauucaaaauucugguggaacaagcauauucgcuggacaccuaaaaugucgauuaaagauggacaaacuugaacugaaaggaaugaguuacgcaauguguacaaauacguuuguacuaaaaaaagaaguaagcgaaacucaacauggaacaauuuuaauaaaaguagaauauaaaggagaagauguucccuguaaaauacccuucucaacagaagauggacaaggaaaagcacauaaugggagguuaauaaccgcgaauccaguugucacaaaaaaggaagaaccaguaaauauagaagccgaaccaccauuuggagaaaguaacauaguuauuggaauaggagauaaugcucuaaaaaucaauugguauaaaaaagguaguucaauuggaaaaauguuugaagcaacggcaagaggagccagaagaauggcgauacuaggagacacggcaugggauuuuggaagcguaggagggguuuuaaacaguuuagguaaaaugguacaccaaauauucgguagugcauacacagcauuauucucaggaguuagcuggguaaugaaaauaggaauaggaguacuauugacauggauaggauuaaauagcaaaaauacgucaaugucuuucucauguauugcuauagggauaauuacucuauacuuaggagcuguaguacaagcuuag

SEQ ID NO: 2295 - RNA, 2037 nt, Artificial Sequence
  derived and/or modified CDS sequence (opt6) from DENV-3 Consensus__SSopt-prME(F108S)
augaaaagaaaaaaaacaucauuaugucuaaugaugauauuaccugcagcacuagcguuucacuuaacaucacgagauggcgaaccccgaaugauaguagggaaaaaugaaaggggcaaaagcuuacuauuuaaaacagcaucugguauaaacauguguacauuaauagcaauggauuuaggagaaaugugugaugacacaguaacauauaaauguccacacauaacugaaguagaaccagaagauauugacuguuggugcaauuuaacaaguacguggguuacauacggaacauguaaucaagcaggcgaacauaggagagauaaaagaagcguagcacuagccccacacguagguaugggauuagauacaagaacacaaacauggaugucagcagaaggagcauggcgacagguagaaaaaguagagacaugggcucuaagacauccugguuuuaccauuuuagcucuauuuuuagcacacuauauuggaacaaguuuaacacaaaaaguagucauauuuauauugcucaugcuaguaacaccuaguaugacaaugcgauguguaggaguaggaaauagggauuuuguagaaggauuaagcggagccacauggguagauguaguucuagaacauggaggauguguaaccacgauggcuaaaaauaaaccaacucuagacauagaacuacaaaaaacagaagcuacacaauuggcaacucuuagaaaauuauguauagaaggaaaaauaacaaacauaacuacggacagccgauguccaacacaaggagaagcaacauuaccugaagaacaagaccaaaauuacguuuguaaacauacauacguggacaggggaugggggaauggcugcggacuaagcggaaaaggaaguuugguaacgugugcuaaauuucaaugucuagaacccauagaaggaaaaguuguacaauaugaaaacuuaaaauauacaguaauuauaacaguacauacaggugaucaacaucaagucggaaaugaaacgcaaggcguaacugcagaaauaacaccucaagccaguacaaccgaggcaauauuaccggaauauggaacacucggauuggaauguagcccaagaacugguuuagacuuuaaugaaaugauauuauuaacaaugaaaaauaaagcauggaugguucauaggcaaugguucuucgauuugccauuaccuuggaccaguggggcaaccacagaaacuccaaccuggaauagaaaagaacuucuuguaacauuuaaaaaugcacaugcaaaaaaacaggaaguaguaguccuaggaucacaagaaggagcuaugcauacagcacuuacaggcgcaacagaaauucaaaacagcgguggaacaagcauauuugcaggacaccuaaaaugucgauuaaaaauggacaaauuggaauuaaagggaaugagcuaugcaauguguacgaacacauuuguauuaaaaaaagaaguaucugaaacucaacacggaacaauccuaauaaaaguagaauauaaaggagaagauguaccauguaaaauaccauucagcacagaagauggacaaggcaaggcccauaauggaagacuaauaacagcaaauccaguuguaacuaaaaaagaagaaccgguuaauauagaagcagaaccuccauuuggagaaagcaauauagugauaggaauaggagacaacgcuuuaaaaauaaacugguauaagaaagguuccaguauaggaaaaauguuugaagcaacagcaaggggagcuagaagaauggcuauauuaggagacacagcaugggauuucgggucaguuggugguguauuaaacagcuuaggaaaaaugguacaucaaauauuugguagugcauacacagccuuguuuucuggaguaucauggguaaugaaaauaggcauuggaguucuacuaacuuggauaggacugaauaguaaaaauacaagcaugaguuuuucgugcauagccauaggaauuauaaccuuguauuuaggagcagucguacaagcauaa

SEQ ID NO: 2296 - RNA, 2037 nt, Artificial Sequence
  derived and/or modified CDS sequence (opt6) from DENV-3 Consensus__SSopt-prME(H27N)
augaaaagaaagaaaacaagucuaugucuaaugaugauuuuaccugcagcauuagccuuucauuuaaccagcagagauggagaaccaagaaugauaguaggaaaaaaugaaagaggaaaaagcuuauuauucaaaacagcaagcggaauaaacaugugcaccuuaauagcaauggaucucggugaaaugugugaugauacuguaacauauaaauguccacacauaacggaaguugaaccugaagacauagauuguuggugcaauuugacaaguacauggguaaccuaugguacaugcaaccaagcaggagagcauagaagagauaaaagaaguguugcguuagcaccacauguaggaaugggauuggacacuagaacccaaacauggaugagugcagaaggagcauggagacaaguagaaaaaguagaaacaugggcccucagacauccaggcuuuacaauacuagcccuauucuuagcacauuauaucggaacaagccuaacacaaaaagugguaauauucauauuauuaauguugguaacuccaagcaugacaaugagaugugugggaguuggaaaucgagacuucguugaaggacuaucuggugcuacauggguagacguaguauuagaaaauggaggauguguaacaacaauggcaaaaaacaaaccaacacuagauauagaacuucaaaagacagaagcgacacaacuugcuacacuaagaaagcuaugcauagaagggaaaauaacaaauauaacaacugauucuagauguccaacucaaggagaagcgacauuaccggaagagcaagaucaaaauuacguauguaaacauacauauguagauagaggcugggguaauggaugugguuuauuuggaaaagggucauuaguaaccugcgcaaaauuucaauguuuagaaccuauagaagguaaaguaguccaauaugaaaauuuaaaauacacaguaauaauaacaguccauacaggcgaccaacaucaaguggguaaugaaacacaaggaguuacugccgaaauaacgccacaagcauccacuacagaagcaaucuuaccagaauacggaacauuaggauuagaauguaguccacgaacaggauuagacuuuaacgaaaugauauuauuaacaaugaaaaauaaagcauggaugguccauaggcaaugguucuuugacuuaccucuaccauggacaaguggagcaaccacugaaacaccaacauggaacagaaaagagcuacuaguaacauucaaaaaugcacacgcaaaaaaacaagaaguaguaguauuaggaagucaagaaggagcaaugcacacagcauuaacaggagccacagaaauacaaaauucaggaggaacuucaauauucgcaggacauuuaaaaugcagacuaaagauggacaaauuagaacucaaaggaaugucuuacgcaauguguacaaauacauuuguacuaaaaaaagaaguaucagaaacucaacaugguacaauacuaauaaaagucgaauauaaaggagaagacguacccugcaaaauaccauuuucaacagaagaugggcagggcaaagcgcauaauggaagacuaauaacagcaaacccaguagugacaaaaaaagaagagcccguaaauauagaagcagaaccuccauuuggugaaaguaacauaguuauaggaaucggagacaaugcacuaaaaauaaauugguacaaaaaaggaaguucaauaggaaaaauguuugaagcaacagcgagaggagcuagacgaauggcuauuuuaggagauacugcuugggauuucggaucaguaggcggaguauuaaauuccuuagguaaaaugguacaucaaauauuuggaagcgcauauacggcgcuauucucaggaguaaguuggguaaugaaaauaggaauuggaguacuauuaacauggaucggauuaaacagcaaaaauacuucaaugagcuuuucauguauugcaauaggaauaauaacacuuuauuuaggggcgguuguacaagcuuaa

SEQ ID NO: 2297 - RNA, 2037 nt, Artificial Sequence
  derived and/or modified CDS sequence (opt6) from DENV-3 Consensus__SSopt-prME(T76I)
augaaacgaaaaaaaacaucguuauguuuaaugaugauauuaccagcggcauuagcauuccacuugacaucaagagacggagaaccaagaaugauaguaggaaagaacgaaaggggcaaaucauuauuauuuaaaacugccucaggcauaaacauguguacauuaauagcaauggaccuaggagaaaugugugacgauacaguuacauacaaauguccacauauaacugaaguagaaccagaagacauugauuguuggugcaaucuaacauccacauggguaacauauggaacauguaaucaagcaggagaacacagaagagauaaaagaucaguagcauuagcuccacacgucggaaugggacuagauacacguacucaaaccuggaugagugcagaaggagcauggagacagguagaaaaaguagaaacuugggcuuuaagacauccaggauucacaauccuugcauuguuuuuagcacauuacauaggaaccucucuuacacaaaaaguggugauauuuaucuuacuaaugcuaguaacgccuaguaugacuaugcgauguguaggcguuggaaaccgagauuucgucgagggauuaagcggagcaacaugggucgacguaguauuagaacauggagguuguguaacaacuauggcaaaaaauaaaccaacauuagacauagaauuacaaaaaacagaagcaacacaauuagcaacacucagaaaacuauguauagaaggaaaaauaaccaauauuacaacugauucacgaugcccaauucaaggagaagcaacacuacccgaagaacaagaucaaaauuaugugugcaaacacacauacguagauagagguuggggcaauggauguggauuauuuggaaaaggcucacucgucacuugcgcaaaauuccaaugccuugaaccaauagaagguaaaguaguacaauacgaaaaucuaaaguacacaguaauaauaacaguacauacgggagaucaacaucaagucggaaaugaaacacaaggaguuacagcagaaaucacaccgcaagcaucaaccacagaagcuauacugccagaauacggaacacuaggucuugaaugcucaccuagaacaggauuagacuuuaacgaaaugauauuauuaacuaugaaaaauaaagcuuggaugguacaucggcaaugguuuuucgauuuaccacuuccauggacaaguggagcaacaacagaaacaccaacuuggaaccgcaaagaauuacuaguaacuuucaaaaaugcacaugcaaaaaaacaagaaguaguagucuuaggaucacaagaaggagcuaugcauacagcuuuaacuggagcaacagaaauacaaaauagcgguggaacaaguauauucgcaggacauuuaaaauguagguuaaaaauggacaaauuagaauuaaaaggaaugaguuaugcaauguguacaaacacguuuguacuaaaaaaagaaguaucagaaacacaacacgguacaauacuaauaaaaguagaauauaaaggagaagaugugccauguaaaauaccauucucaacagaagauggacaagguaaagcacauaauggacgacuaauuaccgcuaauccaguugucacaaaaaaagaagaaccaguaaauauagaagcagaaccuccauucggagagaguaauauaguaaucggaauaggagacaaugcccuuaaaauaaauugguauaagaaaggcucaaguauuggaaaaauguucgaagccaccgcaagaggagcacgacgaauggcaauacuaggcgauacagccugggacuucgguagcguuggaggaguauuaaauucauuaggaaaaaugguacaucaaauauucggaagcgcguauacagcauuauuuagcgggguuucuuggguaaugaaaauaggaauaggaguauuacuaacuuggauaggauuaaacucuaaaaacacaucaaugucauuuagcuguauagcaauaggcauaauuacauuauauuuaggggcaguaguacaagcauaa

SEQ ID NO: 2298 - RNA, 2037 nt, Artificial Sequence
  derived and/or modified CDS sequence (opt6) from DENV-3 Consensus__SSopt-prME(N89D)
augaagagaaaaaagacgaguuuauguuuaaugaugauuuuaccugcugccuuagcuuuccauuuaacaucaagagauggagaaccaagaaugauaguaggaaaaaaugaaagaggaaaaagucuauuauuuaaaacagcaagcggaauaaauauguguacuuuaauagcuauggaccugggagaaaugugugacgacaccguaacuuauaaauguccucauaucacagaaguagaaccagaagauauagauugcuggugcaaccuaacgucaaccugggugacauauggaacuuguaaucaagccggagagcacaggagagacaaaagaagcguugcauuagcaccccauguuggaaugggauuagauacaagaacgcaaacuuggaugagugcagaaggagccuggagacaaguagaaaaaguagaaacaugggcucuaagacauccaggauuuacaauacuagcauuauuucuagcacacuauauaggaacaucauuaacacaaaaaguagucauuuuuaucuuauuaauguuaguaaccccuagcaugacaaugagauguguuggaguuggaaaccgagacuuuguagaaggucuuaguggagcaacaugggucgauguuguauuagaacacgguggaugcguaacaacgauggccaaaaauaaaccaacauuggauauagaauuacaaaaaacugaagcuacacaauuagcaacgcuaagaaaauuauguauugagggaaaaauaacuaauauaacaacagauagcagguguccaacucagggcgaagcaaccuuaccugaagaacaagaucaagauuauguauguaaacacacuuauguagauaggggauggggaaauggcuguggauuauuuggaaaaggaagcuuaguaacgugugcaaaauuucaaugucuugaaccaauagaaggaaaaguaguucaauaugaaaaucuuaaguauacaguaauaauuacagugcacacaggagaucaacaccaaguaggaaacgaaacgcaggggguaacggccgaaauuacgccacaagcaucaaccacagaagcaaucuuaccagaauauggaacacuaggacucgaauguaguccuagaacaggauuagauuuuaacgaaaugauauuauuaacaaugaaaaauaaagcguggaugguacauagacaaugguucuuugauuuaccacuaccauggacaagcggugcaacgacagaaacaccaacauggaacagaaaagagcuacuaguaacauucaagaaugcacacgcuaaaaaacaagaaguaguaguacuaggcagccaagaaggugcuaugcauacagcacugacaggagcaaccgaaauacaaaacucaggagggacgucuauauuugcaggucauuugaaaugcagauuaaaaauggacaaauuagaacuaaaaggaaugucuuacgcaauguguacaaauacauucgugcucaaaaaagaaguuucagaaacgcaacaugggacaauacugauaaaaguagaauauaaaggugaagacguuccaugcaaaauacccuuuagcacagaagauggacaaggcaaagcacauaauggaagacuaauaacagcaaaucccguaguaacaaaaaaagaagagccugugaacauagaagcagaaccaccuuucggugaaaguaacauaguaauagguauuggagauaaugcguuaaaaauaaauugguacaaaaaagguaguagcauaggaaaaauguuugaagcaacagccagaggcgcaagaagaauggcaauacuaggugauacagcaugggacuuuggaaguguagguggaguauuaaacucauuaggaaaaaugguccaccaaauauuuggaagugcauauacagcacuauuuaguggagugagcuggguaaugaaaauaggaauaggaguacuacuuaccuggauaggacucaauaguaaaaauacgaguaugucuuuuaguuguauagcgauagggauaauaacauuauauuuaggagcaguaguacaggcguaa

SEQ ID NO: 2299 - RNA, 2037 nt, Artificial Sequence
  derived and/or modified CDS sequence (opt6) from DENV-3 Consensus__SSopt-prME(Y96H)
augaagagaaaaaaaacaagucuaugccucaugaugauucuuccggcugcacuagccuuucacuuaacaucaagagauggagaacccagaaugauaguagggaaaaaugaaagagguaaaucacuauuauuuaaaacagccaguggaauuaauauguguacauugauugcaauggaucuaggagaaaugugcgaugacacaguaacauauaaauguccucauauaaccgaaguagaaccagaagauauagauugcugguguaaucuuacaaguacauggguaacauauggaacauguaaucaagcaggagaacauagaagagauaaacgaucaguagcacuagcaccacauguaggcaugggacuagauacaagaacgcaaacauggaugagcgcagaaggggcauggagacaagucgaaaaaguugaaacuugggcacuaagacauccaggauucacaauacuggcauuauuucuagcacauuauauugguacaaguuuaacacaaaaaguugucauauucauuuuacuaauguugguaacaccaaguaugacuaugagauguguaggaguaggaaacagagauuuuguagaaggcuuaucaggagcaacauggguagauguaguacuagaacacgguggaugugugacuacaauggcaaaaaauaaaccaacucuagacauagaacuacaaaaaacagaagcuacacaguuagcuacauuaagaaaacuguguauagaaggaaaaauaacaaacauuacaaccgauagucgaugcccaacccaaggagaagcaacacucccagaagaacaagaucaaaauuacguuuguaaacauacacacguagauagaggaugggguaauggcuguggauuauuuggaaaagggucauuaguaacaugugcaaaguuccaauguuuagaaccuaucgaaggaaaaguaguacaauaugaaaaucuaaaauauaccguaauaaucacaguacacacaggagaucaacaccaaguaggaaaugaaacacaaggaguaacagcugaaauaacaccacaagcuucaacaacugaagcuauauuaccagaauacggaacuuuaggacuagaaugcagcccaagaacaggccuagacuuuaacgaaaugauuuuacuuaccaugaaaaauaaagccuggaugguucacagacaaugguucuuugacuuaccacuuccauggacaaguggagcaacaacagaaacaccaacauggaaucgaaaagaacuauuaguaacuuuuaaaaacgcacacgcaaaaaaacaagaaguaguuguuuuaggcucucaggaaggagcuaugcauaccgcguuaacaggagcaacagaaauacaaaauucgggaggaacauccauauucgccggucauuuaaaaugccgauuaaagauggauaaacuugagcucaaaggaaugagcuaugcuaugugcacaaauacuuuuguacuaaaaaaagaaguaucagaaacucaacauggaacuauacuaauaaagguagaauauaaaggagaagaugucccauguaaaauaccauuuucuacagaagauggucaaggcaaagcucauaacggacguuuaaucacagcaaacccaguagucacaaaaaaagaagaaccaguaaauauagaagcagaaccaccauuuggugaaucaaauauagucauagguauaggagauaaugcauuaaaaauaaauugguauaaaaaagguucaaguaucggcaaaauguuugaagcaacugcuagaggagcaagaagaauggccauuuuaggagauacugcuugggauuucggaagcgugggcggaguacuaaauucucucggaaaaaugguucaucaaauauuugguucagcauacacagcauuauucaguggaguaagcuggguuaugaaaaucgggauagguguuuuauuaacuuggauaggacuaaauaguaaaaacacaucaaugucguuuucauguaucgcaauaggaauaauaaccuuauauuuaggagcaguaguucaagcauaa

SEQ ID NO: 2300 - RNA, 2037 nt, Artificial Sequence
  derived and/or modified CDS sequence (opt6) from DENV-3 Consensus__SSopt-prME(K110E)
augaagagaaaaaaaacaucacuauguuuaaugaugaucuuaccagcagcccuagcuuuucauuuaaccagccgagauggagaaccaagaaugauaguagguaaaaacgaaaggggaaaaagucuacuauuuaaaacugcaucuggaauaaacauguguacguuaauagccauggauuuaggagaaaugugugacgauacagugacuuacaaauguccccauaucacagaaguagagccggaagauauagauugcugguguaaucuaacaucuacauggguaacauauggaacaugcaaucaagcaggagaacauagaagagacaaaagaaguguagcauuagcuccgcacguaggaaugggauuagauaccagaacccaaacuuggaugagcgcagaaggggcguggcgacagguagaaaaaguagaaacaugggcauugagacacccgggauuuacuauuuuagcauuauuucuagcacacuauauaggaacaucuuuaacacaaaaagucgugauauuuauacuucuaaugcuagucacaccuagcaugacaaugagaugcguaggggugggaaauagggacuuuguggaaggauuaucuggugcaacauggguagacguuguacuagaacauggcggaugcguaacuacaauggcaaaaaauaaaccgacauuagauauagaauuacaaaaaaccgaagcaacgcaauuagcaacuuuaagaaaauuaugcauagaagguaaaauaacaaauaucacaacagacaguagguguccaacacagggugaagccacauuaccagaagaacaagaucaaaacuauguauguaaacauacauauguggauagaggauggggaaauggauguggacuauuuggugaaggcucauuagucacaugugcaaaauuucaaugucuagaaccuauagaaggaaaagugguucaauacgagaaucuaaaauacacaguuauaauaacagugcauacaggagaucaacaucagguuggaaacgaaacacagggaguaacagccgaaauaacaccacaagcaucaacaacagaagcuauacuaccugaguacgguacacuaggauuagaauguucaccaaggacgggacuagauuucaacgaaaugauucuauuaaccaugaaaaacaaagcauggaugguacacagacaaugguuuuuugaucuaccacuaccauggacuagcggugcuacaacagaaacaccaacauggaauaggaaagaauuauuaguaacuuucaaaaaugcacaugcuaaaaaacaggaaguaguagucuuaggaucacaagaaggagcgaugcauacagcauuaacuggagcaacugaaauccagaauucuggagggacaaguauauuugcaggacacuuaaaauguagacuaaaaauggacaaacuagaauuaaaagggaugagcuaugccauguguacaaacacuuucguccuaaaaaaagaaguaagugaaacacaacauggaacaauacuaauuaaaguugaauacaaaggagaggauguucccugcaaaauuccauuuuccacagaagauggacaaggaaaagcacauaauggaagauuaaucacggcaaaucccguuguaacgaaaaaagaagaaccagucaauauagaagcggaaccaccauucggagaaucaaauauaguaaucggaauaggagauaaugcacuaaaaauaaauugguacaaaaaaggcaguagcauaggaaaaauguucgaagcaacggcucgaggagcgagaagaauggcaauauuaggcgauaccgcaugggauuucgggagcguagguggaguauuaaacucacucggaaaaaugguacaucaaauauuuggaagugcuuacaccgcgcuauuuagcgguguaaguuggguaaugaaaauaggaauuggcguucugcuuaccuggauaggguuaaacaguaaaaacacaagcaugagcuuuaguuguauagcgauaggaaucauuacacuauauuugggagcaguaguacaagcauaa

SEQ ID NO: 2301 - RNA, 2037 nt, Artificial Sequence
  derived and/or modified CDS sequence (opt6) from DENV-3 Consensus__SSopt-prME(H149N)
augaaaagaaagaaaacaucauuauguuuaaugaugauauuaccagcagcauuggcauuccauuuaacuagcagggauggagaaccaaggaugauaguagguaaaaacgaaagaggaaaaagucuauuguuuaaaacagcaagcggaauaaauauguguacacuaauugccauggaccuaggagaaaugugugacgauacaguaacauacaaaugcccacauauaacagaaguagaaccagaagauauagacuguuggugcaaucugacaaguacuuggguaacuuauggaacaugcaaucaggcaggagaacauagacgagauaaaagaucgguugcacucgcaccacacguaggaaugggacuagauacaagaacacaaacauggaugucagccgaaggagcauggcgacagguggaaaaagucgaaacuugggcacuucgucacccaggauuuacgauuuuagcacuauucuuagcacacuauauuggaacaaguuuaacccaaaaaguaguuauuuuuauacugcuaaugcuaguaaccccaagcaugacuaugcguuguguaggcguaggaaauagagauuuuguagaaggauuaaguggagcuacguggguagauguaguacucgaacauggugguugugugacaacaauggcuaaaaacaaaccgacauuagauauagaauugcagaaaacagaagcgacacaauuagcaacucuaagaaaauuaugcauagaaggaaaaauaacaaauauaacaacugacaguagaugcccgacacaaggcgaagcaacauuaccagaagaacaagaucaaaauuauguauguaaacauacauauguagauagaggcugggguaacggauguggauuauuugguaaagggagcuuaguaacaugcgcuaaauuucaauguuuagaaccuauagaaggaaaagugguacaauaugaaaaccuaaaauauacaguaauaauaacuguacauacaggugaucaaaaucaaguuggaaaugaaacacaaggagugacagcagaaauuacaccccaggcuucaacaacagaagcaauuuuaccagaauacgguacauuaggauuagaaugcagcccaagaacuggccuagacuuuaacgagaugauauuacuaacaaugaaaaauaaggcauggaugguucaucgacaaugguuuuucgauuuaccacuuccguggacaaguggggccacaacagaaacaccaacauggaauagaaaagaacuauuaguaacauuuaaaaaugcgcaugcuaaaaagcaagaaguaguaguucucggaucacaagaaggugcaaugcauacugcauuaacaggagcaacugaaauucaaaauagcgguggaacuagcauauuugcagggcacuugaaaugcagauuaaaaauggacaaacuugaacuaaaaggaaugagcuaugcgauguguacaaauacauucguauuaaagaaagaagugagcgaaacacaacacggaacaauauuaauaaaaguugaauacaaaggcgaagacguaccuuguaaaauacccuucaguaccgaagacggucaaggaaaagcacauaauggacgcuuaauaacugcaaauccaguaguaacaaagaaagaagaaccaguaaacauagaagcagaaccaccauuuggagaaagcaauauugugauaggaauaggggacaacgcacugaaaauaaacugguauaagaaaggaagcucaauagguaaaauguuugaagcuacggcacgaggagccagaaggauggcaauauuaggugauacugcaugggacuuuggaaguguuggaggaguacuaaauucacucggcaaaaugguacaucaaauauuuggaagugcauacacugccuuauucucaggaguaaguugggucaugaaaauaggaauuggaguguuacuaacauggauagguuuaaauaguaaaaauacaaguaugucauucagcuguauagcaauagguaucauaacauuauacuugggugcaguuguacaagcauag

SEQ ID NO: 2302 - RNA, 2037 nt, Artificial Sequence
  derived and/or modified CDS sequence (opt6) from DENV-3 Consensus__SSopt-prME(S184F)
augaaaagaaagaaaacuagcuuauguuuaaugaugauacugccggcugcccuagcauuucauuugacaaguagagacggagaaccaagaaugauaguaggcaaaaacgaacggggaaaaucacuacucuuuaaaacagcuucaggaauuaacauguguacacuaauagcaauggaucuaggagaaaugugcgaugauacaguaacuuacaaauguccccauauaacagaaguagaaccagaagauauagauugcugguguaaucuaacaucaacauggguaacauauggaacaugcaaucaagcaggagaacauagaagagauaaaagaucaguggcauuagccccacauguaggaaugggacuagacaccagaacacaaacuuggaugagugcugaaggagcauggagacaaguugaaaaaguagaaacaugggcauuaagacacccaggauuuacaauccuagcauuauuucuugcgcauuauauaggaaccucacuuacacaaaaaguaguaaucuuuauacuauuaaugcuaguaacccccagcaugacaaugagauguguagguguugguaacagagauuuuguagaaggauuaucaggagcaacauggguagacgugguacuagaacauggaggauguguaacaacaauggcuaaaaauaaaccaacacuggacauagaauuacagaaaacagaagcaacacaacuagcaacacuaagaaaauuauguauagaaggaaagauuacaaauauaacaacagacaguagaugcccgacccagggugaagcaacguuaccagaagaacaagaccaaaauuacguaugcaaacacacauauguagacagagguuggggcaauggaugugguuuauuuggcaaaggaaguuugguaacaugugcaaaauuucaaugucucgaaccaauagaagguaaaguaguucaauacgaaaauuuaaaauauaccgucauaauuaccguacauacaggcgaucaacaccaaguaggaaaugaaacccaaggcgucacagcagaaauaaccccacaggcaagcaccacagaagcgauuuugccugaauacgggacauuaggauuagaauguuuuccacgaacaggauuagacuucaaugaaaugauuuuauuaacaaugaaaaauaaagcauggaugguucauaggcaaugguucuuugauuuaccauuaccauggacgagcggagcaaccacagaaacaccaacuuggaauagaaaagagcucuuaguuacauucaaaaacgcgcaugcuaaaaagcaagaaguaguaguauuaggaucucaagaaggagcaaugcacacugcacuaacaggagccacugaaauacaaaauucaggaggaacgucaauauuugcaggacaccuaaaauguagauuaaaaauggauaaacuagaacuaaaaggaaugaguuaugccauguguacaaauacauucguauuaaagaaagaagucagcgaaacucaacauggaacuauauuaauaaaaguugaauauaaaggagaagauguacccugcaaaauaccauuuaguacugaagauggacaaggaaaagcacacaauggacgauuaauaacagcuaacccaguaguaacaaagaaagaagaaccaguaaacauugaagcagaaccaccuuucggcgaaaguaauaucguaauugggauaggcgauaaugcuuuaaaaauaaauugguacaagaaagguucuucaauaggaaaaauguuugaggcuacugcaagaggugcuagaagaauggcaauacuaggggauacagcaugggauuucggauccguaggagggguacuuaauagucuagguaaaauggugcaucaaauauuuggaagugcuuauacagcacuguucucggguguaucaugggucaugaaaauagggauuggaguuuuauuaacuuggauaggauuaaauaguaaaaauacaaguaugucauuuucauguauagcgauaggaauuauaacuuuauacuugggagcagucguacaagcauaa

SEQ ID NO: 2303 - RNA, 2037 nt, Artificial Sequence
  derived and/or modified CDS sequence (opt6) from DENV-3 Consensus__SSopt-prME(R186L)
augaaaagaaagaaaacaucccuaugucuaaugaugauauugccagcugcauuagcauuccauuugacaagcagagauggagaaccccgaaugauagucgguaaaaaugaaagagguaaaucacuauuauuuaaaacagcuucaggaauaaauaugugcacgcuaauagccauggauuuaggagaaaugugugaugauacaguuacauauaaaugcccacauauaacagaaguagaaccagaagauauagacuguuggugcaacuuaacaagcacgugggucacuuauggaacauguaaccaagcgggcgaacaccgacgagauaaaagaucaguagcccuagcaccucauguaggaaugggacuagacaccagaacacaaacauggaugucagcagaaggagcauggagacaaguugagaaaguagaaacaugggcuuuaagacauccagguuucacaauacuagcuuuguuuuuagcacauuacaucggaacaucacuaacacaaaaagugguaauuuuuauucuacucauguuaguuacaccaucaaugaccaugagguguguaggaguuggaaacagagacuucguagagggcuuaaguggagccacauggguagacguaguuuuagaacauggagguuguguaacaacaauggccaaaaauaaaccaacucuagacauagaauuacaaaaaacagaagccacacaacuagcaacacuacgaaaacuauguauagaagggaaaauaacuaauauaacaaccgauucacgaugcccaacacaaggugaagcaacuuuaccagaagaacaagaucagaauuauguuugcaaacauacauauguugaccgagguuggggaaacggauguggucuauuuggaaaaggaagccuaguaacaugugcuaaauuucaaugcuuagaaccaauagaaggaaaaguaguacaauacgaaaauuuaaaauauacaguuaucaucaccgugcacacuggggaucaacaucaaguggggaaugaaacacaaggaguaacagcugaaauaacaccacaagcaaguacaacagaagccauauuaccugaauaugggacauuaggacuagaaugcuccccacucacuggguuagauuuuaaugaaaugauauuauuaaccaugaaaaacaaagcauggaugguccacagacaaugguuuuucgauuuaccauuaccauggacaucaggagcaacaacagaaacaccaacauggaacagaaaagaauuauuaguaacauucaaaaaugcacaugcuaaaaaacaagaaguagugguucuaggaagucaagaaggagcaaugcacacagcccuaacuggagcaacagaaauacaaaacucuggcggcacaagcauauuugcuggacaucuaaaguguagauuaaaaauggauaaauuagagcuuaaagguaugaguuaugcaauguguacaaauacauuuguguuaaaaaaagaagucucagaaacacaacauggaaccauacuaauaaaaguugaauacaaaggagaagauguuccauguaaaauaccauucaguacagaggauggacaaggaaaagcacauaauggaagacuaauaacugcaaauccaguaguuacuaaaaaagaggaaccaguaaauauugaagcggaaccaccauucggagaaaguaauauagugauaggaauaggugauaaugcacuaaaaauaaauugguacaaaaaaggaucaucaauuggaaaaauguucgaagcaacagcaaggggcgcuaggagaauggccauauuaggggacacagcaugggauuuuggaagcguaggaggaguauuaaauucucuagguaagaugguacaucaaauauuugguucggcauacacagcacuauuuucagguguaaguuggguuaugaaaauaggaauagguguguuacuaacauggauagguuuaaauaguaaaaacacgaguaugaguuucagcuguauagcaauaggaauaauaacacuauaucuaggugcgguaguacaagcauaa

SEQ ID NO: 2304 - RNA, 2037 nt, Artificial Sequence
  derived and/or modified CDS sequence (opt6) from DENV-3 Consensus__SSopt-prME(N240S)
augaaaagaaaaaaaacaagucuaugcuuaaugaugauauuaccagcagcacuagcauuccaccuaacaucacgagauggugaacccagaaugauaguaggaaaaaaugaaagaggaaaaucucuucuauuuaaaacagcuucuggaauaaacaugugcacacuaauagcuauggaccuaggagaaaugugcgaugacacuguaacauacaaauguccacauaucacagaaguggaaccugaagauauagauuguugguguaaucuaacaagcaccugggugacguauggaacaugcaaucaagcaggugaacacaggagagauaaaagaagcguagcacuagcuccacacgucggaaugggguuggauacacgaacucaaacguggaugagcgcagaaggugcauggcgucaaguagaaaaaguugaaacaugggcgcugagacacccagguuuuacaauauuagcucuauuuuuagcucauuacauaggaacaucuuuaacucaaaaagucguaauauuuauuuuacuaaugcuaguaacaccaucaaugacaaugagaugcguuggaguaggaaauagagauuucguugagggauuaaguggagcaacauggguugacguaguauuagaacacggaggcugcguaacaacuauggcuaaaaacaaaccaacauuagacauagaacuucaaaaaacagaagcuacacaauuagcaacacuaagaaaauuauguauagaaggaaaaauaacaaauauaaccacagauaguagauguccgacacaaggugaagcaacgcuaccagaagaacaagaucaaaacuauguuuguaaacauacauacguggauagaggauggggaaauggcuguggucuguucggcaaaggaucauuaguaacaugcgcaaaauuucaaugucuagaaccaauagaaggaaaaguagugcaauaugaaaaccuuaaauacacaguaauaauaaccguccacacaggagaccaacaucaaguaggaaacgaaacacaaggagucacagcagagauaacgccacaagcaaguacaacagaagcaauacuaccagaauacggaacauuaggacuagaauguucaccaagaacaggacuagacuuuaaugaaaugauacuauuaacuaugaaaaauaaagcauggaugguucauagacaaugguucuuugaccuaccacuaccguggacgagcggagcaacaacugagacuccaacuuggaauagaaaagagcuauuaguaacauuuaaaagugcacaugcaaaaaaacaggagguaguaguauugggaucacaggaaggagcaaugcauacagcauuaacuggcgcaaccgagauacaaaauucgggaggaacaucaauauuugcaggacaucuuaaauguagacuuaaaauggauaaacucgaacuaaaaggcaugagcuaugcaauguguacuaauacauuuguacugaaaaaagaaguuucagaaacgcaacaugguacaauauuaaucaaaguagaauauaaaggagaagacguaccaugcaaaauaccauuuaguacagaagauggacaaggcaaggcucauaacgggagacuuauaacagccaauccuguaguaacaaaaaaagaagaaccgguaaacauagaagcagaaccgccguuuggcgaaagcaauauagugauaggaaucggggacaaugcucuaaaaauaaauugguacaaaaaaggaagcaguauaggaaaaauguuugaagccacggcaaggggagcaagaagaauggccauuuuaggagacacagcaugggauuucggcaguguaggagggguuuuaaauucacuaggaaaaaugguacaucaaauauucggaagcgcauacacagcuuuauucucaggaguuagcuggguaaugaaaauagguauaggaguacuauugaccuggauuggguuaaauaguaaaaacacaaguaugagcuuuucauguauugcaauaggaauaauaacauuauaccuaggggccguagugcaagcauga

SEQ ID NO: 2305 - RNA, 2037 nt, Artificial Sequence
  derived and/or modified CDS sequence (opt6) from DENV-3 Consensus__SSopt-prME(M258L)
augaaacguaaaaaaacaucacuuugccuaaugaugauauuacccgcagcucuagccuuccacuuaacuagucgugauggagaaccaaggaugauaguaggaaaaaacgaaagagguaaaucauuauuauuuaaaacggcaucaggaauaaacaugugcacauuaauagcaauggauuuaggcgaaaugugugaugauacaguaacauauaaauguccacauaucacugagguagaaccagaggacauugauugcugguguaacuuaacuucaacauggguaacauauggaacauguaaccaagcaggagaacauagaagagacaaaaggaguguagcuuuggcaccacacguaggaaugggucuagauacaagaacacaaacauggaugucagcagaaggagcauggagacaaguagaaaaaguagaaacaugggcacuaagacauccuggauuuacaauacuagcauuauuuuuagcacauuauauuggaacaagccucacucaaaaaguaguuauauuuauuuuauuaauguuaguaacaccaagcaugacaaugagauguguaggaguaggaaacagagacuuuguagaagggcuaagcggagcaacauggguagacgucguguuagaacauggaggauguguaacaacaauggcaaaaaauaaaccgacauuagauauagaacuacaaaaaacugaagcaacacaacuagcaacauuaagaaaacuauguauagaaggaaaaauaacaaacauuaccaccgacagcagauguccaacacaaggagaagcaacgcuaccagaagaacaagaccaaaauuacguaugcaaacauacuuauguagaucgaggcuggggaaacggauguggauuauuuggaaaaggaucauugguaacaugugcuaaauuucaaugucucgaaccuauugaaggaaaaguaguacaauaugagaacuuaaaauacacaguaauuauaacgguacauacuggagaccaacaucaaguagguaaugaaacacaagguguaacagcagaaauuacaccgcaagcaucaaccaccgaagcuauauuaccagaauaugguacccuaggcuuagaauguagcccaagaacaggacuagauuuuaaugaaaugauacuauuaaccaugaaaaacaaagcauggaugguacauagacaaugguuuuuugaccucccgcuacccuggacaucaggagcgacuacugagacaccuacauggaaccgaaaagaauuacuagucacuuuuaaaaaugcccaugcuaaaaaacaagaaguugugguacuaggaagccaagaaggggccuuacacacagcauuaacgggugcuacagaaauacagaauucagguggaacaucaauauucgcaggucaucuaaaauguagauuaaaaauggacaaauuagaacucaaagguaugucauaugccauguguacaaauacauucguauuaaaaaaagaagucucagagacacaacauggaacuauccuaauaaaggucgaauauaaaggggaagauguaccuuguaaaaucccuuuuucaacagaagacggccaaggaaaagcucacaauggaaggcuaauaacagcaaaucccguaguaacaaaaaaagaagaaccaguuaauauagaagcagagccaccauuuggcgaaaguaacauaguaauugggauaggagacaacgcgcugaaaauaaauugguauaaaaaagguaguaguauaggaaaaauguuugaggcaaccgcaagaggugcaagaagaauggcaauauuaggugacacagcaugggacuucggaaguguagguggaguauuaaauucgcuuggcaaaaugguacaucaaauauuuggaagugcauacacagcucuauuuagcggaguuagcuggguaaugaaaauagguauuggaguacuacuuacauggauaggguuaaauaguaaaaauacaaguaugucuuuuagcugcauagcuauuggaauaauaacacuauauuuaggugcaguuguacaagcauaa

SEQ ID NO: 2306 - RNA, 2037 nt, Artificial Sequence
  derived and/or modified CDS sequence (opt6) from DENV-3 Consensus__SSopt-prME(H259N)
augaaacgaaaaaaaacaagucuaugcuuaaugaugauccugccagcagcacuagcuuuucauuuaacuucaagagauggcgaaccacgaaugauaguuggaaaaaacgaaagaggaaaaaguuuauuauuuaaaacugcaucaggaaucaacauguguacguuaauugccauggauuuaggcgagaugugugaugauacuguaacauauaaauguccccauaucacagaaguugaaccggaagacaucgauuguugguguaaccuuacaagcacauggguaacauacggaacauguaaucaagcgggagaacauagaagagacaaaaggaguguugcguuggcaccacacguaggaaugggacuagauacgcgaacacaaacuuggaugagugcugaaggagcauggagacaaguagaaaaaguagaaacuugggcacuuagacacccgggcuuuaccauauuagcauuauuucuggcacauuauaucggaacaucacuaacucaaaaaguaguuauauuuauacuucuuaugcuagugacaccuagcaugacaaugcgaugcguaggaguaggaaacagagacuuuguagaaggccuaaguggagcaaccuggguagauguuguacuagaacacggugguuguguaacaacuauggcaaaaaauaaaccaacucuagacaucgaacuacaaaaaacagaagcaacucaauuagcuacacuaagaaaauugugcauagaaggaaaaauaacaaacauaacgacagauucacgauguccaacacaaggugaagcaacauuaccagaagaacaagaucaaaauuauguauguaaacauaccuacgucgacaggggauggggaaauggauguggcuuauuuggaaaagguagcuuaguaacaugcgcuaaauuucaauguuuagaaccgauagaagguaagguaguacaauaugaaaauuuaaaauacacaguaauaauaacuguacacacaggcgaccaacaucaaguugguaaugaaacacaaggaguaacggcagaaauaacuccacaggcuucaacgacagaagcaauacucccagaguauggaacauuaggauuagaaugcagcccaagaacaggcuuagauuuuaaugaaaugauacuauuaacaaugaaaaauaaagcuuggaugguucaucgacaaugguuuuuugauuuacccuuaccauggacaucaggagcaacuacagaaacaccaacauggaauagaaaagaauuauuaguaacauuuaaaaaugcacaugcaaaaaaacaagaagugguaguccuagggucacaagaaggagccaugaacaccgcguuaacaggagcaacagaaauccaaaauagugguggaacaucuauauucgcaggucauuugaaaugucgccucaaaauggacaaacucgaacuaaaaggaaugucauaugcuauguguacaaauacauucguacuaaaaaaagaagucagugaaacacaacauggaacaauacucauaaaagucgaauauaaaggcgaagacguacccuguaaaauaccauuuagcaccgaagacggacaaggaaaggcacauaacggaagacuaauuacagcuaauccaguuguaacuaaaaaagaagaacccguuaacauagaggcagaaccuccauucggcgaaaguaauauaguaaucggaauaggggauaaugcauuaaaaauaaacugguacaaaaaggguagcaguauaggaaaaauguuugaagcaacagcaagaggcgccagaagaauggcaauauuaggugauacugcaugggacuuugggucuguaggaggaguccuuaauagccuuggaaaaaugguacaccaaaucuuugggagcgcauacacagcauuauuuaguggaguaaguuggguaaugaaaauaggaauaggaguccuauuaacauggauaggacuaaauagcaaaaacacaaguaugucguucaguuguauagcaauaggaauaauaaccuuguauuugggagcagucguccaagcuuaa

SEQ ID NO: 2307 - RNA, 2037 nt, Artificial Sequence
  derived and/or modified CDS sequence (opt6) from DENV-3 Consensus__SSopt-prME(H259R)
augaaaagaaaaaagacaaguuuaugccuaaugaugauacuaccugcagcucuagcauuucauuuaacgucccgagacggcgaaccgaggaugauuguaggaaagaaugagagaggaaaaucauuacuauuuaaaacugcaagcggaauaaacauguguacauuaauagcaauggaccucggagaaaugugugacgauacuguaacauacaaauguccucacauuacagaaguugaaccagaagacauagauuguugguguaauuuaacaucuacuuggguaacuuauggaacauguaaucaggcaggggagcauaggagagauaaaagaucuguagccuuggcaccacauguaggcaugggauuagacacaagaacacaaacauggaugagugcagaaggggcauggagacaaguagaaaaaguagaaacaugggcucucagacauccagguuuuacaauacuagcacuauuucuagcacauuauauagggacaucauuaacacaaaaaguaguaauauucauauuauuaauguuagucacaccgaguaugacaaugaggugcgucggaguuggaaauagagacuuugucgaaggcuuaaguggcgcuacauggguagacguaguauuagaacacggcggaugugugaccacaauggcuaaaaauaaaccaacucuagauauagaauuacaaaaaacagaagcaacccaauuggcaacuuuaaggaaacuauguauagaaggaaaaauuacaaauauaacaacugauagcagguguccaacccaaggagaagccacacuaccagaagaacaagaucaaaauuauguauguaaacacacauauguugauagagguuggggaaauggauguggauuauuuggaaaaggaaguuuaguaacgugcgcuaaauuccaaugccuugaacccauagaagguaaagugguucaauaugagaauuuaaaauauacgguaauuauaaccguacauacaggagaucagcaucaaguaggcaacgaaacacaagggguuacagcagagauaacaccacaagcaucaacaacagaagcaauauuaccagaauacggaacacuaggccuagaaugcaguccaagaacaggauuagacuuuaacgaaaugauacuacuaacaaugaaaaauaaagcauggaugguccauagacagugguucuucgacuuaccccuuccauggacgaguggagccaccaccgaaacuccaacuuggaauagaaaagaacuacuaguaacauucaaaaaugcacaugcaaaaaaacaagaaguuguuguauuaggcucacaagaaggagcaaugagaaccgcacuaacaggugcaacagaaauacaaaauucuggaggaacaucaauauucgcagggcaucugaaauguagacugaaaauggacaaauuagaauuaaagggaaugagcuaugcaauguguacaaacacauucguguuaaaaaaggaaguaagugaaacgcaacaugggacuauauuaauaaaaguagaauauaaaggagaagacguaccauguaaaauaccauuuagcacagaagauggacaaggaaaagcacauaacggacguuuaauaacugcaaauccgguugucacaaaaaaagaagaaccuguaaacauagaagcggaaccgccauuuggggaaaguaauauuguuaucggcauaggagauaaugcgcuaaaaauaaacugguacaaaaaaggauccucaauaggaaaaauguucgaagcaacagcaagaggagcaagaagaauggcuauauuaggagauaccgcaugggauuuuggaaguguaggaggaguacuaaauucacuaggaaaaaugguacaucaaaucuuuggaagcgcguauacagcauuauuuaguggaguaaguuggguaaugaaaauagguauaggcguguuauuaacauggauagguuuaaauagcaaaaauaccucaaugaguuucagcuguauagcuauagguauaauaacuuuguauuuaggugcaguaguacaagcauaa

SEQ ID NO: 2308 - RNA, 2037 nt, Artificial Sequence
  derived and/or modified CDS sequence (opt6) from DENV-3 Consensus__SSopt-prME(A265T)
augaaaagaaagaaaacuucauuaugccuaaugaugauacuuccugcugcauuagcguuccaucuaacaucaagagauggagaaccaagaaugauaguaggcaaaaacgaaagaggaaaauccuugcuuuuuaaaacggcaagcggaauaaacauguguacacuaauagccauggauuuaggagaaaugugugacgauaccguuacauauaaauguccacauaucacugaaguagaaccagaagauauagauuguuggugcaauuuaacgagcacauggguaaccuacggaaccuguaaccaagccggcgaacaccggagagacaaaagaucaguagcucuggcaccacacguagguaugggauuagacacaagaacgcaaacauggaugucagcggaaggcgccuggagacagguagaaaaaguagaaacaugggcacuaagacauccgggcuucaccauauuagcacuauuuuuagcacauuacauagguacuucacuaacacaaaaaguagugauauuuauacuacuuauguuaguaacaccaagcaugacaaugagaugcguaggaguugguaauagagacuuuguugaaggacuaucaggagcaacuuggguagauguaguauuagaacauggaggcugugugacaacaauggcgaaaaauaaaccaacacuagauauagaauuacagaaaacagaagcaacgcaauuagcaacgcugagaaaacuauguauagaaggaaaaauaacgaacauaacaacagacucacgauguccaacccaaggagaagcaacauuaccagaagaacaagaccaaaacuauguaugcaaacauacguacguagauagggguugggguaacgguuguggacuauuuggaaaaggaaguuugguaacaugugcuaaauuucaauguuuagaaccaauugaagguaaaguaguacaauaugaaaaucucaaauauacuguaauaauaacuguacacacuggugaucaacaccaaguaggaaaugaaacacaaggaguaacugcugaaauuacaccacaagcaaguacaacagaagcaauacucccagaauauggaacauugggauuagaauguuccccaagaacaggcuuggacuucaaugaaaugauacuuuuaacaaugaaaaauaaagcguggaugguccaucgacaaugguucuuugaccucccauugccauggacaaguggugcgacaacagagacaccgaccuggaacagaaaagaacuauuaguaacauucaaaaaugcacacgcuaagaaacaagagguaguuguacuaggcagucaagaaggagcaaugcauaccgccuuaacuggcacaacugaaauucaaaauaguggaggaacgaguauauuugcaggucaucuaaaauguagacucaaaauggauaaacucgaacuaaaaggaaugucauacgcaaugugcacaaauacuuuuguacuaaagaaagagguaagugaaacacaacaugggacaauacuaauaaaaguagaauacaaaggugaagacgucccauguaaaauaccauuuagcacggaagacggccaaggaaaagcacauaacgguagauuaauaacugcuaauccaguuguaaccaagaaagaagaacccguaaauauugaagcugaaccucccuuuggcgaaucaaauauuguaauagguauaggagauaaugcucuaaaaaucaauugguauaagaaaggaagcucaauaggaaaaauguuugaagcaacagcacgaggagcaagaagaauggcaauacuaggagauacugcaugggacuuuggaucaguagguggagucuuaaacuccuuagguaaaaugguucaccaaauauucggaagcgcauauacagcauuauucucaggaguaucauggguaaugaaaauaggaauaggcguauuacucacauggauaggacuuaauagcaaaaauacaucaaugucauuuuccuguauagcaauaggaauaauaacuuuauacuuaggggcugucguacaagcauag

SEQ ID NO: 2309 - RNA, 2037 nt, Artificial Sequence
  derived and/or modified CDS sequence (opt6) from DENV-3 Consensus__SSopt-prME(S296G)
augaaacguaaaaaaacaaguuuaugcuugaugaugauauuaccagcagcauuagcauuccacuuaaccucaagagauggagagccaagaaugauaguagguaaaaaugaaaggggcaaaagcuuguuauuuaaaacagcuaguggaauaaauaugugcacauuaauagcaauggaccuaggagaaaugugugaugauacagugaccuacaaauguccacacauaacagaaguagaaccagaagauauagauuguugguguaacuuaacuaguacauggguaacauacggcacaugcaaccaagcaggagaacacagaagagauaaaagaucaguagcauuggcaccucauguaggaaugggauuagauacaaggacacaaacauggaugagugcagaaggagcuuggagacaaguagagaaaguagaaacaugggcacuaagacauccaggauuuaccauuuuagcgcuauucuuagcacacuacauuggcacaucacuaacacaaaaaguugucauauuuauacuacuaauguuaguaacaccaagcaugacaaugagauguguaggaguaggaaaucgagauuucguugaaggauuaagcggagcuacguggguugauguaguacuagaacauggagguugcguaacaacaauggcaaaaaacaaacccacauuagacauagaacuacagaaaacagaagcaacacaauuagcuacauuaagaaaauuaugcauugaggguaaaauuacaaauauaacaacugauagcagaugcccaacacagggagaagcaacacuaccugaagaacaagaccaaaauuacguaugcaaacacacauacguugaucgagguuggggaaauggaugcggauuauuuggaaaaggaaguuuaguaacaugcgcaaaauuccaaugcuuagaaccaauagaagggaaaguaguccaauaugaaaaucugaaauauacaguaauaauaacaguacacacaggagaccaacaucaaguaggcaacgaaacacaaggaguuacagcagaaauaacaccacaagccucaacaacagaagcaauacuuccugaauacggaacucuaggauuagaaugcucaccuagaacaggacucgacuucaacgaaaugauacuucugacaaugaaaaacaaagcauggaugguccaccgacagugguucuucgauuuaccacuaccauggacaucaggugccacaacugaaacaccaacguggaauagaaaagaacuuuuaguuacauucaagaacgcacaugcaaaaaaacaagaaguaguaguacuaggaucacaagaaggggcaaugcauacagcuuuaacaggagcaacugaaauacaaaauucaggaggaacaaguauauucgcaggucaucuaaaaugcagauuaaaaauggauaaauuagaacuuaagggaaugggauaugcaaugugcacaaacacauuuguguuaaaaaaagaaguuucggaaacucaacacggaacaauacuaauaaaaguagaauauaaaggugaagauguaccaugcaaaauaccauuuaguaccgaagauggucaaggaaaagcacacaaugggagauuaaucacagcaaauccuguuguaacgaaaaaagaagaaccaguaaauauagaagcagaaccacccuucggagaaagcaauauaguaauaggaaucggagacaaugcuuuaaaaauaaauugguauaaaaaagguucaucaaucggaaaaauguucgaggccacagcccggggagccagaagaauggcaauccuaggagacacagcuugggauuucggaagcguagguggaguacuaaauagucuaggaaaaaugguacaucaaauauucgggagugcauacaccgcuuuguuuagcggaguaaguuggguaaugaaaauagguauaggcguacuuuuaacauggauagggcuuaacucaaagaacacaagcaugaguuuuaguugcauagccauuggaauaauaacgcuauacuugggugcagucguacaagcauaa

SEQ ID NO: 2310 - RNA, 2037 nt, Artificial Sequence
  derived and/or modified CDS sequence (opt6) from DENV-3 Consensus__SSopt-prME(S311R)
augaaaagaaaaaaaacaaguuuguguuuaaugaugauucuaccagcagccuuagcauuucacuugacaucaagagauggagaaccaagaaugauaguaggaaaaaaugaaaggggcaagagccucuuauuuaaaacagcuagcggaauaaacauguguacauuaauagcaauggacuugggugagaugugcgaugauacaguaacauauaaauguccacauauuacagaaguagaaccagaagacauagauuguuggugcaauuuaacuaguacaugggugaccuauggcacuugcaaucaagcaggcgagcauagacgagauaaaaggucaguggcauuagccccacacgugggaaugggacuugacacaagaacgcaaacauggaugagugcagaaggggcauggcgccaaguagaaaaaguugaaacaugggcauuaagacauccaggauuuacaauuuuagcauuauuuuuagcacauuauauaggaacuagcuuaacacaaaaaguuguaauauucauacucuuaauguuaguuacaccgagcaugaccaugcgauguguaggaguagggaacagagauuuuguagaaggacuuaguggagcaacauggguagauguaguacuggaacacggagguugugugacaacaauggcaaaaaacaaaccaacacuagacauugaacugcaaaaaacagaagccacucaauuagcaacucuaagaaaacuguguauugaaggaaaaauaaccaauauuacaacugauucaaggugcccuacacaaggagaagcaacucuaccagaagagcaagaucaaaauuauguaugcaaacauacguacguagauaggggauggggaaauggguguggacuauuuggaaaaggaaguuuggucacaugugcaaaauuucagugccuggagccuauagaagguaaaguaguccaauaugaaaacuuaaaauauacggucaucauaacaguucacacaggggaucaacaucaaguaggaaacgagacacaagguguaacagcagaaauaacaccacaagcauccacaacagaagcaauacuaccagaauacggaacguuaggcuuagaauguuccccuagaacaggucuagauuucaaugaaaugauacuauuaacgaugaaaaauaaagcuuggaugguacauaggcagugguuuuuugaccucccacuuccauggacaaguggugcuacaacagaaacaccaacuuggaacagaaaagaauuauuaguuacuuuuaaaaacgcacaugcaaaaaaacaggaaguaguagucuuaggcucacaagaaggagcuaugcauacagcauuaacaggagcaaccgaaauacagaauucaggcggaacaagcauauucgcaggacaccuaaaauguagauugaaaauggauaaauuagaacuaaaagguaugaguuaugcaauguguacaaauacauuuguacucaaaaaagagguaagagaaacccaacaugguacaauacuaauaaaaguagaauauaaaggcgaagauguaccaugcaaaauaccauuuucaacggaagauggucaaggcaaagcacauaauggaagauuaauaacagcaaauccugugguaacaaaaaaagaagaaccagucaauauagaagccgaaccaccauucggcgagaguaacauugucauaggaauaggggacaaugcucugaaaauaaauugguauaaaaaaggaaguucaauaggaaaaauguuugaagcaacagcaagaggagcaagaagaauggccauauuaggugauacagcaugggauuuugguagcguaggaggaguucuaaauucacucggaaaaaugguccaccaaauauucggaagugcauacacagcacuauucaguggagugucuuggguaaugaaaauagggauaggcguauuacuaacauggauaggacugaacagcaaaaacacgucuaugaguuuuagcugcauugcaauuggaauaauaacauuauacuuaggagcagugguacaagcauaa

SEQ ID NO: 2311 - RNA, 2037 nt, Artificial Sequence
  derived and/or modified CDS sequence (opt6) from DENV-3 Consensus__SSopt-prME(K321T)
augaaaagaaaaaaaacuucacuaugucugaugaugauacucccagcagcauuggcauuucauuuaacaucaagagauggagaaccgagaaugauaguuggaaagaaugaaagaggcaaaagucuauuauuuaaaacagcuucaggaauaaacaugugcacauuaauagccauggaucuaggagaaaugugugacgauacagugaccuauaaaugcccccauauuacagaaguagaacccgaagauauagauuguugguguaaccuuacaagcacauggguuacauauggcacauguaaucaagcaggugaacauagaagagauaaaagaucaguugcacuggcaccacauguagggaugggauuagauacuagaacacagacauggaugagcgcagagggugcuuggcgucaagucgaaaaaguagaaacaugggcauuaagacauccaggauuuacaauacuagcauuguuucuagcacauuacauaggaacuagcuuaacccaaaaaguagucauauuuauauuauuaauguuaguaacuccgaguaugacaaugagauguguaggaguuggaaacagagacuuuguggaaggccuaucaggagcaacauggguagacguaguacuagaacaugguggauguguuacaaccauggcaaaaaauaaaccaacauuagauauagaauuacagaaaacagaagcuacacaauuagcaacauuaagaaaacuguguauagaagguaaaaucacgaauauuacaacagacaguagauguccaacucaaggagaagcuacacuaccagaagaacaagaucaaaacuacguaugcaaacacacauacguagauagaggcuggggaaacggcugcggauuauucggaaaaggaucuuuaguaacaugugcuaaauuccaaugucuagaaccaauagaagguaaaguaguacaauaugaaaaucuaaaauacacuguaauaauaacaguacacacuggagaucaacaccaaguaggaaaugaaacacaaggcgucacagcagagaucacaccucaggccaguacuacagaagcaauacucccugaauauggaacauuaggauuagaauguucaccaagaacuggacuagauuucaacgagaugauucuauuaaccaugaaaaauaaggcauggaugguucauaggcaaugguuuuucgaucuaccucuaccauggacaucgggugcaacaacugagaccccuacauggaacagaaaagaauuauuaguaacauuuaaaaacgcucaugcaaaaaaacaagaaguaguaguucuaggaagccaagaaggagcaaugcauacagcacucacuggagcaacagaaauacaaaauagcggaggaacaucaauauuugcaggacauuuaaaaugcagguuaaagauggauaaacuagaauugaaaggaaugagcuaugcuauguguaccaacacuuuuguauuaaaaaaagaaguaucagaaacacaacacggcacaauuuuaauaacaguagaauauaaaggagaagauguaccauguaaaauaccuuucagcacggaagauggacaagguaaagcucauaauggacgacuaauaacagcaaauccaguagugacaaaaaaagaagaaccaguaaacauagaagcagaaccacccuuuggagaaaguaacauagugauaggaauaggugacaaugcucuuaaaauaaacugguauaaaaaagggucuucaauaggaaagauguuugaagcaacagcuaggggagccaggagaauggcgauucuaggugacacagcaugggacuuuggaaguguaggugggguuuuaaauagucuaggaaaaaugguacaucagauauuugguagugcauauacagcucuauuuuccgguguaucauggguaaugaaaauagguauuggaguauuauuaacauggauaggauuaaauucaaaaaacacaagcaugaguuucagcuguauagcaauaggaauaauaacucuauaucuaggagcuguaguacaagcauaa

SEQ ID NO: 2312 - RNA, 2037 nt, Artificial Sequence
  derived and/or modified CDS sequence (opt6) from DENV-3 Consensus__SSopt-prME(G28C,H242C)
augaaacgaaaaaaaacaucacuaugucuuaugaugauuuuacccgcagcauuagcauuucacuuaacaagucgagauggagaaccuagaaugauaguuggaaaaaacgaacgaggaaaaagcuuacuauucaaaacagcaucaggcauaaauauguguacacuaauagcaauggacuuaggcgaaaugugugacgauacaguaaccuauaaauguccucacauaacagaaguagaaccagaagacauagauuguugguguaaccucacaucaacauggguaacauacgguacauguaaccaagcaggagaacacagaagagacaaaagaucaguagccuuagcaccacauguagguauggguuuggauacacguacacaaacguggaugucugcggaaggugcuuggcgccaaguagaaaaaguagaaacaugggcacuaagacacccaggauuuacaauauuagcacuuuuucuugcucacuauauaggcacaucacuaacacaaaaaguaguuauauuuauuuuauuaaugcuaguaacaccaagcaugacaaugagauguguaggagucggaaauagggauuucguagaaggucuaucaggcgcaaccuggguugauguaguauuagaacacugugguugcguaacaacaauggcaaaaaauaaaccaacacuugacauagaguuacaaaaaacagaagccacacaacuagcuacauuaagaaaauugugcauagaagguaaaauaacuaauaucaccacagauaguagauguccgacacaaggagaagcaacacuacccgaagaacaagaucaaaauuacguauguaaacacacauauguagaccgcggauggggaaauggcuguggauuauucgguaaaggaaguuuaguaacaugcgcaaaauuccaaugucuagaaccaauagaagguaaaguaguacaauaugagaaucuaaaauauacaguaauaauaaccguacacacaggagaccaacaccaaguaggaaacgaaacgcaaggaguuacagcagaaauuacgccacaagccucaacaacagaagcaauacuuccagaauauggaacacuaggauuagaauguagcccgagaacaggucuggacuuuaaugaaaugauuuuauuaacaaugaaaaauaaagcguggaugguacauagacaaugguuuuuugacuuaccccuaccauggacuucaggagcuacaacagaaacaccuacauggaacaggaaagaacucuuaguaacauuuaaaaacgcuugcgcaaaaaaacaagaagucguuguccuagguucccaagaaggagcaaugcauacagcauuaacaggagcaaccgaaauacaaaauucagguggaacuucuauuuuugccggacaccuaaaaugucgccugaaaauggacaaacuugaacuaaaaggaaugucauaugccauguguacaaacacauucguacugaaaaaagaaguaucagaaacacaacauggaacaauauuaauaaaagucgaauauaaaggagaagauguaccauguaaaauaccauuuucaacagaagauggccaaggaaaagcacauaacggcagauuaauuacugcaaauccuguaguuacuaaaaaagaagagcccguuaacauagaagcagaaccaccauuuggugaaaguaauauagugauaggaaucggcgauaacgcauuaaaaauaaacugguauaaaaaaggaagcagcauaggaaaaauguuugaagcaacagccagaggugcaagaagaauggcaauauugggugacacagccugggacuuugguucaguaggaggaguucuaaauucauuaggaaaaaugguacaucagauauuugguucagcauauacagcacuauuuucgggaguaucauggguuaugaaaauaggaauagguguacuauuaacauggauugguuuaaacucgaagaauacaucaaugucauuuucaugcauagcaauagguauaauaacuuuauauuuaggagcuguaguucaggcauaa

SEQ ID NO: 2313 - RNA, 2037 nt, Artificial Sequence
  derived and/or modified CDS sequence (opt6) from DENV-3 Consensus__SSopt-prME(R186L,A265T)
augaaaagaaaaaaaacuagcuuaugucuaaugaugauacuaccugcagcacuagccuuucauuuaacaaguagggacggagaaccaagaaugauaguaggaaaaaaugagagaggaaaaagcuuacuauucaagacugcaaguggaaucaauauguguacacuaaucgcaauggauuuaggugaaaugugcgacgacacaguaacuuacaaguguccucauauaacagaaguagaaccagaagauauugauuguuggugcaaccuaacgaguacauggguuacuuauggaacauguaaccaagcaggagaacaccggcgagauaaaagauccguggcacuagcaccacauguaggaaugggccuagauacccguacacaaacauggaugagugcggaaggggcguggagacaaguagaaaaaguugaaacuugggcauuacgacacccaggcuuuacuauauuagcauuauuuuuagcacauuacauaggaaccaguuuaacgcaaaaaguagucauauuuauauuauuaaugcuaguaacaccaaguaugacuaugagaugugucggaguaggaaacagagauuucguagaaggacuuaguggagcaacguggguagauguuguacuagaacacggugguuguguaacaacaauggcaaaaaacaaaccgacgcuagacauagaacuacaaaaaacagaagccacacaauuggcaacauuaagaaaauuauguaucgaaggaaaaauaacaaauauaaccacugauucaagauguccaacacaaggcgaagcaacgcuccccgaagaacaggaucaaaauuauguauguaaacacacauacguugaccgcgguuggggaaauggauguggcuuguucggaaaagguucauuaguuacuugcgcgaaauuccaaugcuuagaaccaauagaagguaaaguaguacaauaugaaaaucuuaaauacacuguaauaauaacuguucauaccggagaccaacaucaaguaggaaacgaaacucaaggaguaacagccgaaauaacaccucaagccagcacaacugaagcaauauuaccugaauaugguacuuugggucuagaauguaguccauuaacgggauuagacuuuaacgaaaugauuuuauugacaaugaaaaauaaagcauggaugguacauagacaaugguucuuugauuuaccgcuaccauggacaucaggagcuaccacagaaacaccaacauggaacagaaaagaauuauuaguaacauuuaaaaaugcacaugcaaaaaaacaagaaguuguuguauuaggcucacaagaaggcgcaaugcauacagcauuaacaggaacaacagaaauacagaauucaggaggaaccaguauuuucgccggacauuuaaaauguagacuaaaaauggauaaacucgaacuaaaaggaaugucuuaugccauguguacaaauaccuucguauuaaaaaaagaaguaucagagacacaacauggcacaauacuaauaaaaguagaauauaaaggagaagacguaccauguaaaauacccuuuaguacagaagacggucaaggaaaagcacauaaugguagguugauaacagcaaauccagucguaacaaaaaaagaagaaccaguaaauauagaagccgaaccacccuuuggugaaaguaauauaguuauaggaauaggagauaaugcuuuaaaaauaaacugguauaagaaaggaucaucaauaggaaaaauguucgaagcaacggcaagaggcgcgagaagaauggccauucuaggagauacagcuugggacuuuggaucaguuggagguguauugaacagucuaggaaaaaugguacaucaaauauuuggaucagcauauaccgcguuauuuucaggaguaaguuggguaaugaaaauaggaauagguguacuacuaacauggaucggauuaaauucaaagaauacaaguauguccuucaguuguauagcaauaggaauaauaacacuauauuuaggagcaguaguucaagcauaa

SEQ ID NO: 2314 - RNA, 2037 nt, Artificial Sequence
  derived and/or modified CDS sequence (opt6) from DENV-3 Consensus__SSopt-pr(D104A)ME(F108S)
augaaaagaaaaaagacaagcuuaugucuaaugaugauauuaccagcagccuuagcauuucaucuaacaagucgugacggcgaaccaagaaugauaguaggaaaaaaugaaaggggaaaaucacuauuauuuaaaacugcuucaggcauaaauauguguacauuaauugcuauggaucuaggagaaaugugugacgauacaguuacuuauaaguguccacauaucacagaagucgaaccagaagauauagauuguugguguaacuuaacuagcacauggguaacauacggaacaugcaaccaagccggagaacaucgaagggcgaaaagguccguugcauuagcuccccauguaggaaugggacuagacacaagaacacaaacauggaugagugcagagggugccuggcgucaaguagagaaaguagaaacaugggcauuaagacacccaggauucacaauucuagcacucuuucuagcccacuauauugggaccucauuaacacaaaaagugguaauauuuauuuuacuaauguuaguaacuccaucuaugacaaugagaugcguaggagucggaaauagagauuuuguagaagguuuaaguggagcaacauggguagauguaguacuagaacacgguggguguguaacaacgauggcuaaaaauaaaccaacacuagacauagaauuacaaaaaacagaagcaacccaacuagcaacguuaagaaaauuauguauagaaggaaaaauuacaaauauaacaacagauaguagauguccuacacaaggagaagccacacuuccagaagaacaagaccaaaauuauguaugcaaacauacauauguagauagaggguggggaaacgguugcggacucucuggaaaagguucauuaguuacaugugcaaaauuucaaugccuggaaccaauagaaggaaaaguaguacaauaugaaaacuuaaaauauacaguaauaauaacaguacauacaggagaucaacaccaaguaggaaaugaaacgcaagggguuacagcagaaauaacuccucaggcuagcacaaccgaagcaaucuuaccugaauaugggacuuuaggucuugaauguucaccaagaacuggacuagauuucaaugaaaugauucuauuaacaaugaaaaauaaagcuuggaugguacauagacaaugguuuuuugaccuaccacuaccguggacgucgggugcaacaacugaaacaccaacauggaauagaaaagaacuguuaguaacauuuaaaaacgcacaugcaaaaaaacaggaaguaguaguacuaggaucacaagagggagcgaugcauacagcgcugacaggagcuacagaaauucaaaacaguggaggaacaucaauauuugcaggacauuuaaaaugucgacuaaaaauggacaaacuagaauuaaaagguaugagcuacgcaaugugcacaaauacauuuguauuaaaaaaagaggucucagaaacccaacacggcacaauauuaauuaaggucgaauauaaaggcgaagauguaccauguaaaauaccauucucuacagaagauggucaaggaaaagcucauaauggacgauuaauaacagcaaauccaguagugacaaagaaagaagaacccguaaauauugaagccgagccuccauuuggggaaagcaauauagugauuggaauaggagacaacgcauuaaaaauuaacugguauaaaaaaggaucaucuauagggaaaauguuugaagcaacagcaagaggcgcaagaagaauggcgauauuaggagauacagcuugggacuucggaaguguaggaggcguuuugaauaguuuaggaaaaaugguucaucaaauauuugggagugcuuauacagcauuauuuaguggagucagcuggguaaugaaaaucggaauaggaguauuauuaacauggauugguuuaaauaguaaaaauacuucaauguccuucaguugcauugcaauaggaauaauaacauuauacuuaggugcaguaguucaagcauaa

SEQ ID NO: 2315 - RNA, 2037 nt, Artificial Sequence
  derived and/or modified CDS sequence (opt6) from DENV-3 Consensus__SSopt-pr(D104A)ME(R186L,A265T)
augaaaagaaagaaaacaaguuuaugccugaugaugauacuaccagcagcauuagcauuucacuuaaccucacgagauggagaaccaagaaugauaguagguaaaaaugaaagaggaaaauccuuauuauuuaaaacagcaucaggaauaaauaugugcacacuaauagcaauggauuuaggagagaugugugacgauacaguaacuuacaaauguccucacauaacugaaguggaaccagaagacauagauugcugguguaaucuaacaagcacaugggugacauauggaacaugcaaucaagcgggugaacaucgacgugcaaaaagaucaguagcauuagcaccucacguugguaugggauuagacacaagaacgcaaacauggaugucagcagaaggagcauggagacaaguagaaaaaguagaaacaugggcauuaagacauccaggauuuacaauauuagcucuauuuuuagcgcauuauauaggaaccucauugacacaaaaagucguuauuuuuauauuguuaauguuaguuacaccaaguaugacuaugcgauguguagguguaggaaauagagacuucgucgaaggauuaaguggcgcuacauggguggauguaguacuagaacauggaggaugcguaacaacaauggcuaaaaauaaaccaacccuagacauagaauuacagaaaacugaagcaacacaacuggcaacuuuaagaaaauuaugcauagaaggaaaaauuacaaauauuacaacagauagcagaugcccaacucaaggcgaggcaacgcuuccagaagaacaagaucaaaacuauguguguaaacauacauauguagauagaggaugggguaauggaugcggauuauuuggaaaaggaaguuuaguaacaugugcuaaauuucaaugcuuagaaccaauagaagggaaaguaguacaauaugaaaauuuaaaauacacaguaauaauuaccguacauacaggugaucaacaucaaguaggaaaugaaacucaaggagugacagcagaaaucacaccacaagcaucgaccacagaagcaauacugccugaauauggaacauugggacuagaauguaguccucuaacagguuuggauuuuaacgaaaugauacuauuaacaaugaaaaauaaagcauggaugguacauagacaaugguuuuucgaccuaccgcuuccauggacaucaggagcuacaacugaaacuccaacauggaauagaaaagaacuucuuguaacauuuaaaaaugcucaugcuaagaaacaagaaguaguaguauuaggaagucaagaaggagcgaugcauacugcauugacaggaacaacugagauacaaaacucagggggaacgucaauauuugcagggcacuuaaaauguagauuaaaaauggauaaacucgaauuaaaagggaugaguuacgcaauguguacaaauacauucguauuaaagaaagaaguaucggaaacucaacauggaacaauacugaucaaaguagaauauaaaggugaagacguaccuugcaaaauuccauuuagcacagaagauggccaaggaaaagcucacaauggcagauugauuacagcaaaccccguagucacaaagaaagaagaaccaguaaauauagaagcagagccaccauuuggagaaucuaacauuguaauuggaauuggagauaaugcuuuaaaaauaaauugguauaagaaaggaaguucaauaggaaaaauguucgaagcaacagcaagaggagcacgcagaauggcaauauuaggagacacugcaugggauuucggaucaguaggcggaguauuaaacaguuuaggaaaaaugguucaucaaauauuuggaagcgcauauacagcauuauuuucaggaguaucauggguaaugaaaauaggaauuggaguacuauuaacauggauaggacucaauagcaaaaacacaagcaugucauuuaguuguauagcuauaggcauaauaacucuauaucuaggugcagugguacaggcuuga

SEQ ID NO: 2316 - RNA, 2037 nt, Artificial Sequence
  derived and/or modified CDS sequence (opt6) from DENV-3 Consensus__SSopt-pr(D104A)ME(F108S,R186L,A265T)
augaaacguaaaaaaacuucauuaugucuaaugaugauauuaccagcagcauuagcguuccaucuaacaucacgcgacggagaaccaagaaugaucguagguaaaaaugaacgagguaaaagucuauuauuuaaaacagcaucggguauaaauaugugcacacuaauagcuauggauuuaggagagaugugcgaugacacugugacuuacaaauguccccacaucacggaaguagaacccgaagacauagacuguugguguaacuuaacgucaacauggguaaccuacggaaccuguaaccaagccggagaacauaggagagcaaaaagaucaguagcuuuagcaccacauguaggaaugggucuugauacgcguacucaaacauggaugucagcagaaggagcauggagacaaguugaaaaagucgaaacaugggcguugagacauccaggauuuacaauauuagcacucuuccuagcacauuauauaggaacaagccuaacacaaaaaguuguaauauucauauuauuaaugcucgugacaccaagcaugacaaugagauguguuggagucggaaacagagauuuuguugaaggccuaucuggagcaacauggguagaugugguacuugaacaugguggaugcguaaccaccauggcgaaaaauaaaccaacuuuagacauagaacuacaaaaaacagaagcaacacaacuugcaacauuaagaaaauuaugcauugaagguaaaauaacuaauauuacaacagacaguagaugcccaacccaaggagaagcuacucuuccagaagaacaagaucaaaauuauguaugcaaacauacauacguagauagagguuggggaaauggcugugguuuaucagguaaaggaucauugguaacuugugcaaaauuucaaugucuagaacccauagaaggaaaagucguccaauaugaaaacuuaaaauauacaguaauuauaacuguacauacaggcgaccaacaucaaguagguaaugaaacucaaggaguuaccgccgaaauaacaccacaagcaagcacaacugaggcaauauugccagaauauggaacguuagguuuagaauguaguccacuaacaggauuagacuuuaaugaaaugauauuauuaacaaugaaaaauaaagcauggaugguucauagacaaugguuuuuugaucuaccauuaccauggaccucaggagccacaacagaaacaccaacauggaaccggaaagaacuguuaguaacuuuuaaaaaugcgcaugcaaaaaaacaagaagucguaguuuuaggaagucaagaaggagcaaugcauacagcccuuacuggaacaacagaaauacaaaauucaggugggacaucaauuuucgcaggucaucuaaaauguagauuaaaaauggacaaauuagaacuuaaagggaugucuuacgcaauguguacaaauacuuuuguacucaaaaaagaaguaucagaaacacaacauggcacaauauuaauuaaaguugaauauaaaggagaagacguaccaugcaaaauuccuuucaguacagaagacggacaagguaaagcacauaauggacgacuaauaacagcaaacccaguaguaacaaaaaaagaagaaccaguaaacauagaagcagaaccaccuuuuggagagucaaauaucguaauaggaaucggagauaacgcauuaaaaauaaauugguauaaaaaaggaucuucaaucggaaaaauguuugaagcaacagccagaggcgccagaaggauggcaauauuaggugauacugcaugggauuucgguaguguaggaggaguauuaaacagucugggaaagaugguucaucagauauucggaucagcauauacagcauuauuuucggguguaaguuggguaaugaaaauaggcauaggaguacucuuaacuuggaucggauuaaauaguaaaaauaccaguaugucuuuuagcuguauagcaauaggaauaauuacccuauaucuaggagcaguaguacaagcauaa

SEQ ID NO: 2317 - RNA, 2016 nt, Artificial Sequence
  derived and/or modified CDS sequence (opt6) from DENV-3 Consensus__SSopt-prMEdel101-107,(R99P,F108N)
augaaaagaaagaaaacaucauuaugucuaaugaugauauuaccggccgcauuagcauuucacuuaacaucaagagauggagaaccuagaaugauaguagguaaaaaugaaagaggaaaaucacuuuuauuuaaaacagcaucaggaauuaacaugugcacacuaauagcaauggacuuaggagaaaugugugaugauacuguuacauauaaauguccccauauaacagaaguggaaccagaagauauagauuguugguguaaucuaacgaguaccuggguuaccuacggcacaugcaaccaagcuggagaacaucggagagauaaaagaagcguagccuuagcaccgcacguuggaaugggauuagauacaaggacacaaacauggaugucagcagaaggagcauggagacaagucgagaaaguugaaacaugggcacuacgacauccaggauuuacgauauuagcacuauuucuagcacacuauauuggaacaagucuaacacaaaaaguaguaauauuuauacuauuaaugcuagugacuccaucaaugacuaugagaugcguuggaguaggaaauagagauuuuguagaaggauuauccggagccacauggguagacgugguacuagaacaugguggauguguaacaacuauggcuaaaaauaaaccuacauuagauauagaauuacaaaagacugaagcaacacaauuagcaacauuaagaaaauuaugcauagaaggaaagauaaccaacauaacaacagauucuagaugcccaacacaaggagaagcaacauuaccagaagaacaagaccaaaacuauguauguaaacauacauauguugacccaggaaacggaaaaggaucucuaguaacaugugcaaaauuucaaugucuagaaccaauugaaggaaaaguaguucaauaugaaaacuuaaaauauacaguuauaauaacaguacacacaggcgaucaacaucaaguaggcaaugaaacacaaggcguaacggcagaaaucacuccucaagcauccacaacagaagcaauauuaccugaguauggaacauugggucuagaauguucaccaagaacgggacuugauuucaaugaaaugauucuauuaacaaugaaaaauaaagcuuggauggugcauagacaaugguucuuugaccuaccauugcccuggacauccggagcuacaacagaaacaccaacauggaauagaaaagaacuauuaguaaccuucaaaaacgcccaugccaaaaaacaagaaguugucgugcuaggaucacaagaaggugcaaugcacacugcauuaacaggagcgacggaaauacaaaacucaggaggaaccucaauauuugcaggucaucuaaaauguagauuaaaaauggauaaauuagaauuaaaagggaugaguuacgccauguguacaaauacauuuguccuaaaaaaagaaguaagugaaacacaacauggaacuauauugauaaaaguagaauauaaaggugaagauguaccauguaaaauaccauucucaacagaagauggacaagguaaagcccauaauggacgcuuaauuacagcaaacccugucguaacaaaaaaagaagaacccguuaacauagaagcagaaccuccauuuggagaaucuaacauagucauuggaauaggagauaacgcacucaaaauaaauugguauaaaaaagguucgucaauuggcaaaauguucgaggcuacggccagaggugcacguagaauggcaauauuaggagauacagcaugggauuucggaaguguuggaggaguauuaaauagucuaggaaagaugguacaccaaauauuuggaucagcauacacagcauuauuuucgggaguaucauggguaaugaaaauaggaauaggagucuuacucacauggauaggauuaaauucaaaaaauaccucaaugucauuuucauguauugcaauaggaaucauaacacuguacuuaggagccguugugcaagcauaa

SEQ ID NO: 2318 - RNA, 2037 nt, Artificial Sequence
  derived and/or modified CDS sequence (opt6) from DENV-3 Consensus__SSopt-prMEdelstem_TM-JEV
augaaacguaaaaaaacaagucuaugucuaaugaugauacugccagcagcuuuggccuuucaucuaacuucgagggacggagaaccccgaaugauaguuggaaaaaacgaaagaggaaaaaguuuauuauucaaaacagccucagguauuaauauguguacacuaauagcaauggaccuaggcgaaaugugcgacgauacaguaaccuauaaauguccacauauaacagaaguagaaccagaagacauagauuguugguguaauuuaacaaguacauggguaacauaugguaccuguaaucaagcaggagaacacagacgagauaagagaaguguagcacuagcaccccauguaggaaugggauuagacacaagaacacaaaccuggaugagcgcggaaggugcauggagacaagucgaaaaaguagaaacaugggcacuccgacacccagguuuuacgauacuagcauuguuucuugcucauuauauaggaaccucacuuacacaaaaaguaguaauauuuauauuacuaaugcugguaacaccuaguaugacaaugagauguguagguguaggaaaucgcgauuucguagaagguuugucaggagcuacauggguagauguaguuuuagaacauggcggauguguaacaacgauggccaaaaauaaacccacauuagauauugaacuacaaaagacagaagcaacacaauuagcaacauuaagaaaacuauguauagaaggaaaaauaacaaauauaacaacagauaguagaugcccaacacaaggagaagcaacauuacccgaagaacaagaucaaaacuacguuugcaaacacacauacguagauagaggauggggcaauggaugcggccuauuugguaaaggaucauuaguaacuugugcaaaauuucaauguuuagaaccaauagaaggaaagguaguacaguacgaaaauuuaaaauauacaguaauuauaacaguacauacaggugaucaacaucaaguaggcaacgaaacacaaggaguaacugcagaaauuacaccccaagcuucaacaacagaagcaauacuaccugaauauggaacuuuaggacuagaaugcagcccaagaacagguuuagauuuuaaugaaaugauauuauuaacaaugaaaaauaaagcauggaugguacaucgacaaugguuuuuugauuuaccauuaccauggacaagcggagcuacuacagaaacuccaacuuggaauagaaaagaacuacuaguaacguuuaagaaugcacacgcaaaaaaacaagaaguugucguacuaggcucacaagaaggugcaaugcacacagcauuaacaggugcuacugaaauacaaaauucaggcggaaccaguauauucgcaggacauuuaaaaugucggcugaaaauggauaaacucgaguuaaaagggaugucauacgcaauguguacaaauacauucguauuaaaaaaagaaguuagugagacacaacaugguacaauauuaauuaaaguugaauauaaaggggaagacgugcccuguaaaauuccauuuaguacugaagacggucagggcaaagcacacaauggcagacuaaucacagcaaauccaguaguuacaaaaaaagaagaaccaguaaauauagaagcagaaccuccauuuggagaaagcaacauaguuauaggcauaggagauaacgcucuaaaaauaaauugguauaaaaaagguaguacauuagguaaagcauuuucuacaacuuuaaaaggagcacaaagacuagcggcauuaggagauacagcuugggauuuuggaaguauaggagguguauuuaauaguauugggagagcaguacaucaaguguuugguggagcguucagaacauuauuuggaggcaugagcuggaucacccaggggcuuaugggagcccuauuauuauggaugggaguuaaugccagagacagaucaauagcauuagcauuucuagcaacuggaggugucuuaguuuuucuggcuacaaauguacacgcauaa

SEQ ID NO: 2319 - RNA, 2037 nt, Artificial Sequence
  derived and/or modified CDS sequence (opt6) from DENV-3 Consensus__SSopt-pr(D104A)MEdelstem_TM,(F108S)-JEV
augaaaagaaaaaaaacaaguuuaugcuugaugaugauuuuacccgcagcauuggcuuuccauuuaaccucgagagauggcgaacccaggaugauugucggaaaaaacgaaagaggaaaaagccuacuauuuaaaacagcaucaggcauaaauauguguacucuuauugcaauggaucuaggagaaaugugugaugacacuguaacauauaaaugcccacauauaacggaaguagaaccagaagauauugacugcuggugcaauuuaacaucaacauggguaacauauggaacauguaaucaagcaggagaacauagaagagcaaaaagaaguguagcauuagccccacacguaggcaugggacuagauacaagaacacaaacuuggaugagugcagaaggggcauggaggcaaguagaaaaagucgaaacaugggcauugagacacccaggauuuacuauauuagcgcuauuuuuagcucauuauauuggcacaucauuaacacaaaaaguagugauauucauauuauuaaugcuaguaaccccaucaaugacaaugagaugugucggaguagguaauagggauuuuguggaaggauuaagcggugcaaccuggguagacguuguuuuagaacauggagguugugugacaacaauggccaaaaauaaaccaaccuuagauauagaacuacaaaaaacagaagcaacacaacucgccacauuaaggaaacuaugcaucgaaggaaaaauaaccaacauaacaacugauucaagaugcccaacacaaggagaagcaacucucccagaagaacaagaccaaaauuacguaugcaaacauacauauguagauagaggauggggaaauggauguggacugagcggaaaaggaucauuaguaacaugugcaaaauuccaaugucuagaaccaaucgaaggaaaaguaguccaguaugaaaacuuaaaauauacaguaauaauaacugugcauacaggugaucaacaucaaguaggcaaugaaacgcaaggaguaacagcggaaauaacaccucaagcaucaacaacagaagcaauacuaccagaauacggaacacuuggauuagaauguucuccaagaacaggauuagauuucaacgagaugauacuauuaacaaugaaaaauaaagcauggaugguucacagacaaugguucuuugaucuaccgcuaccauggacaaguggggcaacaacagaaaccccaacauggaauagaaaagaacuuuugguaacuuuuaaaaacgcacaugcaaaaaaacaagaaguuguaguauuaggaagucaagaaggagccaugcacacagcauuaacuggagcaacagaaauacaaaacucagguggaacaucaauauuugcaggacaucuaaaauguaggcuaaaaauggacaaauuagaauuaaaagggaugagcuaugcaaugugcacaaauacuuucguacuaaaaaaagaaguuucagaaacacaacacggaacaauauuaauaaaaguagaauauaaaggagaagacgucccauguaaaauaccuuucucuaccgaagacggacaaggcaaagcacauaacgguagacuuauuaccgcuaauccaguagucacaaaaaaagaagaaccagucaacauagaagcagaaccaccauuuggugaaucaaauaucguuauaggaauaggagauaacgcacuaaaaauuaacugguacaaaaaagguucuacauuaggaaaagcguuuaguacuacauuaaaaggagcccaacgauuagcagcauuaggcgacaccgcuugggauuuugguucaauuggugguguauuuaacucaauaggccgugcaguacaucaaguauucggaggagcauuuaggacauuauucgguggaaugaguuggauuacacaaggauuaaugggagcauuauuacuauggaugggaguaaaugcaagagacaggagcauagcacuagcauuuuuagcaacaggaggaguauuaguauucuuagcuacaaacguacacgcuuaa

SEQ ID NO: 2320 - RNA, 2037 nt, Artificial Sequence
  derived and/or modified CDS sequence (opt6) from DENV-3 Consensus__SSopt-pr(D104A)MEdelstem_TM,(R186L,A265T)-JEV
augaaaagaaaaaaaaccucccuauguuuaaugaugauauugccugcugcauuagcuuuccaccuaacaaguagagauggagaaccgcgcaugaucguaggaaaaaaugagcgagguaaaucauuauuauuuaaaacagcuucaggaauaaacauguguacacucauagcaauggacuuaggagaaaugugugacgauacaguaacauacaaauguccacauauaacagaaguugaaccggaagauauagauuguuggugcaaucuuacaucaacauggguaacuuauggcacguguaaucaagcaggagaacaucgaagagcaaaaagaucuguagccuuagcgccacacguaggcaugggauuagacacuagaacacaaacauggaugucagccgaaggugcauggagacagguagaaaaaguagaaacgugggcacuuagacauccaggguuuacaauacuagcacuauuucuagcacacuauauuggaacaucauuaacacaaaaaguaguaauuuucauauuauuaauguugguaacuccuagcaugaccaugagaugcguaggaguaggaaauagagacuuuguagaaggucugaguggagcaacauggguagacgugguacuggaacauggaggaugcguaaccaccauggcaaaaaacaaaccaacccuagacauagaacuacaaaagacagaagcaacacaauuagcaacauuaagaaaauuauguauugaaggaaaaauaaccaauauaacaacagacaguagguguccaacacaaggagaagcaacucuucccgaagaacaagaucaaaauuacguuuguaaacacacguacgucgauagaggaugggguaauggauguggauuauuuggaaaaggaucauuaguuacgugcgcaaaauuccaauguuuagaaccaauagaaggaaaggucguacaauaugaaaauuuaaaauauacaguaauaauaacuguacauacaggagaccaacaucaaguaggcaacgaaacacaaggaguaacagcagaaauaacaccucaagccucaacaacagaagcuauauuaccagaauacggaacacuaggacuagaauguaguccucuaacgggcuuagauuuuaacgaaaugauacuuuuaacaaugaaaaacaaagcauggaugguucauagacaaugguuuuuugacuuaccacuaccuuggacaaguggagcaacaacagaaacacccacuuggaaucgaaaagaacuauugguaacauuuaaaaacgcccacgcaaaaaaacaagagguaguaguuuuagguucacaagaaggagcuaugcacacagcgcuaacuggaacaacagaaauucaaaauucagguggaacaaguauuuuugcaggacaucuuaaguguagauuaaaaauggauaaauuagaacuuaaagguaugucauaugcaauguguacgaauacauuuguacuaaaaaaagaaguaagugaaacacaacacggaacuauucuaaucaaaguagaauauaaaggcgaagauguacccugcaaaauuccauuuucaacagaagauggccaaggcaaagcacauaacgggcgauuaauuacagcaaauccuguuguuacaaaaaaagaagaaccaguaaauauagaagcagaaccaccauucggugagaguaacauaguaauaggaauaggagacaacgcucuaaaaauaaauugguauaaaaaaggaucaacacuuggaaaagcauuuucaacaacauuaaaaggcgcacaaagauuagcagcuuugggagauacagcaugggacuuuggauccauaggagguguauuuaauucaauuggaagagcaguucaucaaguauuuggaggagcauuucgaacauuauucgggggcaugagcuggauaacacaaggucuaaugggagcauuauuacucuggaugggaguaaacgcuagagauagaucaauagcccuagcauuuuuggccacaggaggcguacuaguauuccuugcaaccaaugugcaugcguaa

SEQ ID NO: 2321 - RNA, 2037 nt, Artificial Sequence
  derived and/or modified CDS sequence (opt6) from DENV-3 Consensus__SSopt-pr(D104A)MEdelstem_TM,(F108S,R186L,A265T)-JEV
augaaacgaaaaaaaacaagucuaugcuuaaugaugauacuaccagcagcgcuagcauuucauuuaacauccagagauggagaaccaagaaugaucgucgggaaaaacgaaagaggaaagucccuacuauuuaaaacagcaaguggaauuaauauguguacuuuaauagcaauggacuugggagagaugugugaugacacagugacauauaaguguccacauauaacagaaguagaaccagaagauauagacuguuggugcaaucucacaucaaccuggguaacauauggaacaugcaaucaagcaggugaacaucgaagagcuaaaagaaguguagcacuggcaccacauguagguaugggacuagacacaagaacgcaaacguggaugagugcagaaggagccuggagacaaguugaaaaaguugaaacuugggcacuuagacauccuggauucacuauauuggcacuauuucuagcacacuauauaggaacaucacuuacacaaaaaguuguaauauucaucuuacuaauguuggucacaccgagcaugacuaugagauguguaggcguuggaaaucgagauuuugucgaagguuuaaguggagcuacauggguagacguaguauuagaacauggaggauguguaacaacgauggcaaaaaacaaaccaacacucgacauugaacuacaaaaaacugaagcaacacaacuagcaacacuaagaaaauuaugcauagaaggaaaaauaaccaauauaacuacagauucaagauguccuacacaaggagaagcaacucuaccagaagaacaagaucaaaauuauguauguaaacacacauauguagauagaggaugggguaauggauguggacuaaguggcaaaggaucauuaguaacaugcgccaaauuucaaugucucgaaccaauugaaggaaaagugguacaauaugaaaaucuuaaauauacaguaauuauaacagugcauacgggggaucaacaucaaguaggcaaugaaacacaagguguaacagcagaaauaacaccacaagcuucaacaacugaagcaauauugccagaauauggaacacuaggacuagaaugcucaccauuaacaggauuagauuucaacgaaaugauacuauuaacaaugaaaaauaaagcguggaugguacauagacaaugguucuuugacuuaccacucccuuggacgaguggagccacaaccgaaacaccaacguggaauagaaaagaacuucuaguuacauuuaaaaaugcucacgcuaaaaaacaagaaguaguaguacuaggaucgcaagaaggagcaaugcacacugcauuaacugguacaacugaaauacaaaauaguggcggaacuucaauauuugcagggcaucuuaaauguagacugaaaauggauaaacuugaacucaaaggaauguccuaugcaauguguacaaauacauuuguacuaaaaaaagaaguuagcgaaacacaacauggaaccaucuuaauaaaaguagaauacaaaggagaggaugucccuuguaaaauaccauuuucaacagaagauggucaaggaaaagcacacaacgguagguuaauuacagcaaaucccguaguaacaaaaaaagaagaaccugugaauauugaagccgaaccaccauuuggagagucaaacauaguaauaggaaucggagacaaugcuuuaaaaauaaacugguauaagaaaggaaguacauuaggaaaagcauuuucaacuacacuaaaaggagcacaaagacuagcagcccuaggagauacagcaugggauuuuggaaguauuggaggaguauuuaauucaauaggaagagcaguacaucaaguauuuggaggagcauuuaggacccuauuugggggaaugucauggauuacucaaggccugaugggagcucuauuauuauggauggggguaaacgcaagagauagaagcauagcauuagcuuuucuugcaacuggaggaguacuuguauuccuagcaacuaauguacaugcauaa

SEQ ID NO: 2322 - RNA, 2037 nt, Artificial Sequence
  derived and/or modified CDS sequence (opt6) from DENV-3 Consensus__SSopt-prMEdelstem_TM,(H259N)-JEV
augaagagaaaaaaaacgaguuuaugcuuaaugaugauauuaccagcggcacuagcauuucauuuaacaagccgagauggggaaccuagaaugauaguaggaaaaaaugaaagagguaagaguuugcuauuuaaaacagcuucagguauaaauauguguacucuuauagcaauggaucuaggugagaugugugacgauacaguaacuuauaaauguccccauaucacagaaguagaaccugaagauauagacugcugguguaaucugacuaguacauggguaacauacggaacguguaaucaagcaggugaacacaggcgagacaaaagaucaguagcauuagcuccucauguaggaaugggacuagacacuagaacgcaaacuuggaugagugcugaaggugcauggagacaaguagaaaaaguagaaacaugggcauuaagacauccaggauuuacaauuuuagcacuauucuuagcgcauuauauaggaacaaguuuaacacaaaaaguaguaaucuuuauacuacuuaugcuaguaacaccaaguaugacaaugagguguguaggaguagguaauagagauuuuguagaaggauuaaguggagcaacaugggucgacguaguacuagaacacggaggaugcguaacuacaauggcaaaaaacaaaccaacacuagauauagaguuacaaaaaacagaagcaacacaauuagcaacauuaagaaaauuaugcaucgaaggaaaaauaaccaauauaacuaccgauucgagaugcccaacacaaggagaagcuacguuaccagaagaacaagaucaaaacuauguaugcaaacauacauauguagauagagguuggggcaauggauguggacuauuugggaaaggaaguuuaguaacuugugcgaaauuucaaugucucgaaccaauagaagguaaaguuguacaauaugaaaaucugaaauauacaguaaucauaacagugcacacgggagaucagcaucaaguagggaacgaaacacaaggcguuacggcugaaauaacaccacaagcuagcacaacugaagcaauauuaccugaauauggaacauuagggcuagaaugcaguccacgaacaggauuggauuuuaaugaaaugauauuauuaacaaugaaaaacaaagcauggaugguccacagacaaugguuuuucgauuuaccauuacccuggacaaguggagcaacaacugaaaccccaacauggaacagaaaagaauuauuaguaaccuuuaagaaugcgcaugcuaaaaaacaagaaguuguaguauuaggaagucaagaaggcgcaaugaauacagcauuaacaggagcaacagagauacaaaacucaggcgguacuucaauauuugcaggacacuuaaaauguagauuaaaaauggauaaacuugaauuaaaaggaaugagcuacgccauguguaccaacacauuuguauuaaaaaaagaagugagugaaacacaacauggcacaauccuaauaaagguagaauauaaaggagaagauguaccauguaaaauaccauuuagcacagaagauggacaaggaaaagcgcauaaugguagauuaauaacagcaaacccaguaguuacgaaaaaagaagaaccaguaaauauagaagcagaaccgccauuuggagaaaguaauauaguaaucgguauaggagauaaugcucuaaaaaucaauugguauaaaaaaggauccaccuuaggaaaagcauuuucaacaacguuaaaaggagcacaaagacuagcggcacuaggcgauacagcaugggauuucgguucaauaggaggaguauucaauaguauaggaagagcaguacaucaaguauuuggaggagcauuuagaacuuuauuuggagguaugaguuggauaacucaaggauuaaugggcgcacuuuugcuuuggauggggguaaaugcaagagaucguucaauugcuuuagccuucuuagcgacagggggaguacuaguauuccucgcuacaaacguacaugcauaa

SEQ ID NO: 2323 - RNA, 2037 nt, Artificial Sequence
  derived and/or modified CDS sequence (opt6) from DENV-3 Consensus__SSopt-prMEdelstem_TM,(R186L,A265T)-JEV
augaaaagaaaaaaaacuagucuauguuuaaugaugauauuaccagcugcuuuagcauuucauuuaacaagcagggacggagaaccuagaaugauaguuggaaaaaaugaaaggggaaaaucacuacuauuuaagacagcaagcggaauaaauaugugcacacuaauagcaauggaucuaggagaaaugugugacgauacaguaaccuauaaauguccucacauaacagagguagaaccggaagauaucgauugcuggugcaaucuaacuaguaccuggguaacauacggaacaugcaaucaagcuggcgaacauaggagagauaaaagauccguagcacuagcuccacacguaggaaugggucuagauacaagaacacaaacauggaugucagcagaaggcgcauggcgacaaguagaaaaaguagaaacgugggcucuuagacauccgggcuucacgauacuggcauuauuccuugcgcauuauaucggaacaucauuaacacaaaaaguaguaauauucauacuacuaaugcuaguaacuccaucaaugacuaugagaugcguaggcguagggaauagagacuuugucgaggguuuaucaggagcaacauggguugauguaguauuagaacacggagguuguguaacuacgauggccaaaaauaaaccuacauuggacauagaauugcaaaaaacagaagcaacacaacuagcaacucuaagaaaauuaugcauagaggguaaaauaacuaauauaacaacagauaguagguguccaacacaaggagaagcuacuuuaccggaagaacaagaucaaaauuacguaugcaagcacacguauguagauagaggaugggguaacggaugcggacuauucggcaaaggaaguuuaguaacaugugcaaaauuucaauguuuggaaccuauugaagguaaaguaguacaauaugaaaauuuaaaauacacaguaauaauaacaguacacacaggugaucagcaucaaguuggaaacgaaacacaaggaguuacugcagaaauaacaccacaagcaucaacuacugaagcaauuuuaccugaauaugguacauuaggacuagaauguucaccucuaacaggacuagacuucaaugaaaugauacuauuaacuaugaaaaauaaagccuggaugguccauagacaaugguuuuucgaccuuccauuacccuggacaaguggcgcgacgacagaaacaccaacuuggaauagaaaagaacuuuuaguaaccuuuaaaaaugcacaugcuaaaaagcaagaaguuguaguauuagguucacaagaaggcgcaaugcauacagcauuaacaggaacuacggaaauacaaaauucaggcggaacaucaauauuugcuggacaucuaaaauguagacuaaaaauggacaaauuagagcuaaaagguaugucguaugcaaugugcacaaacaccuuuguacucaaaaaagaaguaucagaaacacaacacggaacaauauuaauaaaaguagaauauaagggagaagauguuccauguaaaauaccauuuucaacagaagacggacaaggaaaagcacacaaugguagauuaauuacagcaaauccaguaguaacuaaaaaagaagaaccaguuaacauugaagcagaaccuccguuuggagaaagcaacauagucauaggcauaggcgauaaugcauuaaaaauaaauugguacaaaaaaggaaguacacuaggaaaagcauucucaacaacauugaaaggugcacaaagacuagcagcacuaggagacaccgcaugggauuuugguagcauagguggaguuuucaacucaaucggaagagccguacaccaaguauuugguggagcauuuagaacccuauuuggagguaugucauggauuacgcaaggauuaaugggcgccuuauuauuauggauggguguaaaugcccgugacagaagcauagcauuagcuuuuuuagccacugggggagugcuaguauucuuagcuacaaauguccacgcauaa

SEQ ID NO: 2324 - RNA, 2016 nt, Artificial Sequence
  derived and/or modified CDS sequence (opt6) from DENV-3 Consensus__SSopt-prMEdelstem_TM,del101-107,(R99P,F108N)-JEV
augaaaagaaagaaaacuucauuaugucuaaugaugauauuaccagcggcacuagcauuucauuuaacaaguagagauggagaaccacgaaugauuguggguaaaaaugaaagaggaaaaucauuauuauucaaaacagcaucaggaauaaauauguguacgcuaauagcaauggaccugggagaaaugugugaugacacaguaacauauaaauguccacacauaacagaagucgaaccugaagauauagacuguuggugcaaucuaacgaguacuuggguaacauauggaacaugcaaccaagcaggagaacacagaagagauaaacgaucaguugcacuagcaccacauguuggaaugggcuuagacacgcgaacucagacauggaugagcgcagaaggcgcauggagacaaguagaaaaaguagaaacaugggccuuaagacauccuggauucacaauccuagcacuauucuuagcgcacuacauaggaacgucauuaacacaaaaagucguuauauucauuuuacuaaugcuuguaacaccaaguaugacaaugagaugcguaggagucggcaauagagauuuuguagaaggucuauccggugccacauggguagacgugguauuagaacauggaggaugugucacgacaauggccaaaaauaaaccaacauuagauauagaauuacagaaaacagaggcaacacaauuagcaacacuaagaaaauuaugcauagaaggaaaaauaacuaauauaacuacagauucaaggugucccacacaaggagaagcuacuuuaccagaagaacaagaccaaaacuacguauguaaacauacuuauguagauccagguaauggaaaaggaucauuaguaacaugugcaaaauuucaaugcuuagaaccaauagaaggcaaaguaguacaauaugaaaauuuaaaauacacuguaauaauaacaguacauacuggagaucaacaccaaguaggaaacgaaacacaaggaguuacagcagaaauaacaccgcaagccucaacuacugaagcaauauuaccagaauacggaacucuaggauuagaauguuccccacgaaccggacuggacuucaaugaaaugauauuacuaacaaugaaaaauaaagcauggaugguacacagacaaugguucuuugauuuaccuuuaccauggacaaguggagcuacuacagaaacaccaacauggaauagaaaagaacuccuaguaacguuuaaaaaugcacaugcaaagaaacaagaaguaguuguacuaggaagccaagaaggggcaaugcauacagcauuaacaggagcuacagaaauucaaaacagugguggaacaucaauuuuugccggacaucuaaaauguagacuuaaaauggauaaacucgaacugaaaggaaugucauacgcaauguguacuaauacauucgucuuaaagaaagaaguaagugaaacacaacauggaacuauacuuauuaaagucgaauauaaaggagaagauguaccauguaaaaucccuuuuaguacagaagauggacaaggaaaagcacacaacggaagguuaauuacagcaaacccgguuguaacaaagaaagaagaaccaguaaauauugaagcagagccgccuuuuggagaaucuaauauaguaauaggcaucggagauaaugcguuaaaaauaaacugguauaagaaagguucaacauuggguaaagccuuuuccacaacuuuaaaaggagcacaaagauuggcagcuuuaggugauacagcaugggacuuuggaucaauaggaggcguauuuaauaguauagguagagcuguacaucaaguauuuggaggagcauucagaacacuauucggaggaaugaguuggaucacccaaggauuaaugggagcacuucuuuuauggaugggaguaaaugcuagagauaggucuauagcauuagcguuucuugccacaggagggguauuaguauuucuggcgacaaauguacaugcauga

SEQ ID NO: 2325 - RNA, 3081 nt, Artificial Sequence
  derived and/or modified CDS sequence (opt6) from DENV-3 Consensus__SSc-prME-NS1
augacuagcuugugucugaugaugauauuaccugcugcucuagcauuucacuuaacaaguagggauggagagccuaggaugauaguaggcaaaaacgaaagagguaaaaguuuauuauuuaaaacagcuucaggaauaaauaugugcacacuaauagcaauggaucuaggcgagaugugugacgauacagucacauauaaaugcccccacauuacagaaguugagccagaagauauagacuguuggugcaaccuaacaaguacauggguaacauauggcacuuguaaucaagcuggugaacacagacgugacaaaaggaguguugcauuagcaccacacguaggaaugggacuggacacacgaacacaaacguggaugagugcagaaggggcauggcgucaagucgaaaaaguagaaacgugggcuuuaagacauccgggauuuacaauauuagcuuuguuuuuggcacauuauauaggaacaucucuaacccaaaagguuguaauauuuauauuacuuauguuaguaacaccgaguaugaccaugagauguguuggaguuggaaacagggauuucgucgaaggauuaucaggagcgacauggguagacguugugcuugaacacggcggaugugucacaaccauggcuaaaaacaaacccacccuugauauagaauuacaaaagacggaagcaacacaacuagcaacauuacgaaaauuauguauagaaggaaagauuaccaauauaacuaccgauagcagauguccuacacaaggugaagcuacacuacccgaagaacaggaccagaauuacgucuguaaacauacuuauguagauagaggcugggggaauggcuguggccuguuuggaaaagguagccugguaacuugcgcaaaauuccaaugcuuggaaccaauagaagggaaaguagugcaauaugaaaacuuaaaauacacuguaauaauuacaguucauacaggugaccaacaccaaguagguaaugaaacacaaggaguaacugcugaaauuacaccucaagcaagcacaacagaagcaauauugccagaauauggaacccuagguuuagagugcucuccaagaacaggauuagacuuuaaugaaaugauuuuacuaacuaugaaaaauaaagccuggaugguacaucgucagugguuuuucgacuuaccacuaccauggacaagcggggcuacaacagaaacacccacauggaacagaaaagaauugcuaguuacguuuaagaaugcgcaugccaagaaacaagaaguaguaguguuaggaagucaagaaggagcaaugcauacagcucucacaggagcaacagaaauacaaaauucagguggaacaaguauuuuugcuggacauuuaaaaugccgacuaaaaauggacaaacuagagcuaaaagguaugagcuaugcaauguguacuaacacguuuguucucaagaaagaaguaucagaaacacaacaugguacaauccugaucaaaguagaauauaaaggugaggacguucccugcaaaauucccuucagcacagaagauggacaaggaaaagcucacaauggaagacuaauaacugcaaauccaguaguaacgaagaaagaggaacccgugaacauagaggcagaaccaccauuuggcgaaagcaauauuguaauaggcauaggcgacaaugcguuaaaaauaaacugguacaagaaaggaucaucaauuggaaaaauguuugaagcaacugcacgaggagcaagaagaauggccauauuaggugauacugcuugggacuucgggaguguagggggaguuuuaaauucgcugggaaaaaugguucaucaaauuuuuggaagcgcguauacagcacuauuuucagguguaaguuggguaaugaaaauagguauagggguauuacuaaccuggauaggucuuaauaguaaaaauacaaguaugucauucucauguauagcuauaggaauaauaacauuauaccuaggagcuguaguacaagcggacaugggauguguaauaaauuggaaaggaaaagaacuuaaauguggauccggaauauuuguaacaaaugaaguucacaccuggaccgaacaauauaaauuucaagcagauucaccaaaacgcuuggcaacugcaauagcaggagcuugggaaaauggaguaugcggaauuaggucgacaaccagaauggaaaauuuacuauggaaacaaauagcaaaugaauuaaauuauauucuaugggaaaauaacauaaaauuaacuguaguagugggugauauaauaggaguccuugaacaaggaaaaagaacacugacaccacaaccaauggaacuaaaauacagcuggaaaacauggggaaaggcaaaaauagucaccgcugaaacucaaaauaguagcuuuauaauagacgguccuaacacacccgaauguccuucagucucgagagccuggaauguaugggaagucgaagauuauggauuuggaguauucacuacuaauaucugguuaaaauugagagaagucuacacacaauuaugcgaccauagauuaaugucugcagcaguuaaagaugaaagagcaguucaugcagauaugggauauuggauagaaagucagaaaaacgguucauggaaauuagaaaaagcaagucuuaucgaaguaaaaacauguacauggccuaaaagucauacauuauggucaaaugguguacucgaaucagauaugauaauaccgaaaucacuugcuggcccgauaagucaacauaaucauagaccuggauaucauacacaaacagcaggaccauggcacuuaggaaaacuagaacuagauuuuaacuacugcgaaggaacaacaguaguuauaacugaaaauuguggcacaagagguccuucacuuagaacgacaacagugucaggaaaacuaauacaugaguggugcugucgaucauguacauuaccaccauuaagauacaugggugaagauggaugcugguaugggauggaaauacgaccaauaagugaaaaagaggaaaauaugguaaaaucauuaguaagugcguga

SEQ ID NO: 2326 - RNA, 1824 nt, Artificial Sequence
  derived and/or modified CDS sequence (opt6) from DENV-3 Consensus__SSm-EdelTM-linker-ferritin
augacccaaaaagucgucauauuuauacuacuaaugcuagucacuccaucaaugacaaugagauguguugguguaggaaacagggauuucguugaaggacuuagcggagcaaccuggguagacguuguacuagaacacggaggauguguaacaacaauggcaaaaaacaaaccgacucucgacauugaacuacaaaaaacugaagcaacacaauuagcaacauuaagaaaacuaugcauagaaggaaaaauaacaaauauaacaacagauagcagaugcccaacacaaggagaagcuacauuaccugaagaacaagaucaaaacuaugugugcaaacauacuuacguagacagaggauggggcaaugguugcggacuauucgggaaaggaucuuuagucacuugcgcaaaauuucaaugccuagaaccuauagaaggaaaagucguacaauacgaaaauuuaaaauauacuguaauaauaacaguacacacuggcgaucaacaccaaguuggcaacgaaacacaaggaguaacugcugaaaucaccccacaagcaucaacaacugaagcaauauuaccagaauacggaacauuaggucuagaauguagcccaagaaccggccuagacuucaaugagaugauauuauuaacuaugaaaaauaaagcauggaugguacacagacaaugguuuuucgaucucccucuuccauggacaucaggugccacaacagaaacgccaacauggaacagaaaagaacuauuaguaacauucaaaaaugcccacgcaaaaaaacaagaaguagucgucuuaggaagccaagagggcgcuaugcauacagcgcuaacaggagcaacugaaauucaaaacagcggcggaaccucaauauuugcaggccauuuaaaauguagauuaaaaauggacaaacuagaacuaaaaggaaugucauacgcuauguguacaaauacauuuguauuaaaaaaagaagucucagaaacccaacauggaacgauacuaauaaaaguagaguauaaaggcgaagauguuccauguaaaauaccauucagcacugaagacggccaagguaaagcacauaauggaagauuaauaacagcaaauccaguuguaacaaaaaaagaagaaccaguuaacauugaagcagaaccaccauuuggagaaucaaacauaguaauaggaauaggugauaaugcacuaaaaauaaauugguauaagaaaggaagcucaauaggaaaaauguucgaagcaacagcacgaggagcacgucgaauggcuauauugggagauacagcgugggacuucggaaguaguggaggcgauaucaucaaacuacuaaaugaacaaguaaauaaagaaaugcaaucgucaaaccucuauaugucaaugagcaguugguguuauacacauucauuagacggagccggacuauuccuuuuugaccaugcagcagaagaauaugaacacgcaaaaaaacuaauaauauuucuuaaugaaaauaacguaccaguacaauuaacaagcauaagcgcaccagaacauaaauuugaaggacuuacacaaauauuccaaaaagcauacgagcaugaacaacauaucucagaaucaauuaauaacauaguugaccacgcaauaaaaucaaaagaccaugcaacauucaacuuccuacaaugguacguagcagaacaacacgaagaagaaguacuauucaaagauauuuuagauaaaauagaauuaauagguaacgaaaaucauggccuauaucuugcagaucaauacguuaaaggaaucgcaaaaucuagaaaaagcuaa

SEQ ID NO: 2327 - RNA, 1821 nt, Artificial Sequence
  derived and/or modified CDS sequence (opt6) from DENV-3 Consensus__SStPA-WHbcAg-linker-EdelTM
auggacgcaaugaaaagaggacuauguugugugcuauuauuauguggagcuguauuuguagauaguguuacaggaauggauauugacccauauaaagaauuugguucuagcuaccaacuacuuaauuucuuaccccuagauuucuuuccagauuuaaacgcauuaguagauacggcgacagcauuauaugaagaagaauuaacaggaagagaacacugcagcccucaccauacagcaauuagacaagcacuaguuugcugggacgaacuaacaaaacuuauagcauggaugucaucuaauauaacuucugaacaaguaagaacaauaauaguaaaucacguaaaugacacauggggacuaaaaguaagacaaaguuuaugguuucauuuaucaugucugacauuuggucaacacacaguacaagaauuccuaguaagcuuuggaguguggauaagaacaccagcaccauauagaccaccaaacgcaccaauccuauccacauuaccagaacauaccguaauauguggaggggguggauccggagguggaggaaugcgauguguaggaguuggaaauagagacuucguagaaggacuaucaggagcuacauggguagauguaguacuagaacacggaggguguguaacaacaauggcaaaaaauaaaccaacacuagacauugaacuacaaaaaacagaagcaacacaacuugcaacauuaagaaaacuaugcauagaaggaaaaauaacuaauauuacaaccgauaguagauguccaacacaaggugaagcgaccuuacccgaagaacaagaucaaaacuauguguguaaacauacuuauguggaucgaggauggggaaauggauguggcuuauucggaaaaggaucauuaguaacaugugcaaaauuccaauguuuagaaccaauagaaggaaaaguaguacaauaugaaaaucuaaaauauacgguaauaauaacaguacauacuggugaccaacaucaaguaggaaaugaaacacaaggagucacagcugaaaucacaccacaagcaucaacaacagaagcgauauuaccagaauaugguacauuaggacuagaaugcucaccacgaacaggauuagauuuuaaugaaaugauauuacuaacaaugaaaaacaaagcauggaugguacaucgacaaugguucuuugaccuaccauuaccuuggacauccggagcaacaacggaaacaccaacauggaauagaaaagaauuacugguaacauucaaaaaugcacaugcaaaaaaacaagaaguaguaguacuaggaucacaagaaggggcaaugcauacagcacucacaggagcaacagaaauacaaaacagugguggaacaucaauuuuugcaggucacuuaaaauguagacuaaaaauggauaaauuagaauuaaaggguaugaguuaugcuauguguacaaacacauuuguacuaaaaaaagaagucagugagacacaacacggaacaauauuaauaaaaguagaauauaaaggcgaggacgucccuugcaaaauaccauucucgaccgaagauggacaaggaaaggcacacaacggaagacuuauaacagcaaacccaguaguuacaaaaaaagaagaaccaguuaauauagaagcggaaccaccauuuggagaaucaaauaucguaauuggaauaggagacaacgcucuuaaaauaaauugguacaaaaaaggaucauccauaggaaaaauguuugaagcuacagcaagaggugccagaagaauggcaauacuaggugauacugcuugggauuuuggaagcuga

SEQ ID NO: 2328 - RNA, 75 nt, Artificial Sequence
  derived and/or modified CDS sequence (opt11) from Homo sapiens__SigSeq(TPA)/SStPA
auggacgcgaugaagcgcgggcucuguugcgugcucuugcucuguggcgcggucuuugucgauagcgugaccggg

SEQ ID NO: 2329 - RNA, 489 nt, Artificial Sequence
  derived and/or modified CDS sequence (opt11) from Helicobacter pylori J99__Ferritin
gacaucaucaaacuccucaacgaacaagucaacaaagaaaugcaauccuccaaccuauacaugagcauguccucauggugcuacacccacucccucgacggcgccggccucuuccucuucgaccacgccgccgaagaauacgaacacgccaaaaaacucaucaucuuccucaacgaaaacaacgucccaguccaacucaccuccaucuccgcccccgaacacaaauucgaaggccucacccaaaucuuccaaaaagccuacgaacacgaacaacacauauccgaauccaucaacaacaucgucgaccacgccauaaaauccaaagaccacgccaccuucaacuuccuccaaugguacgucgccgaacaacacgaagaagaaguccuauucaaagacauccucgacaaaaucgaacucaucggcaacgaaaaccacggccucuaccucgccgaccaauacgucaaaggcaucgccaaaucccgcaaaucc

SEQ ID NO: 2330 - RNA, 450 nt, Artificial Sequence
  derived and/or modified CDS sequence (opt11) from Woodchuck hepatitis virus__WHbcAg
auggacaucgaccccuacaaagaauucggcuccuccuaccaacuccucaacuuccucccccucgacuucuuccccgaccucaacgcccuagucgacaccgccaccgcccucuacgaagaagaacucaccggccgcgaacacugcuccccccaccacaccgccauccgccaagcccucgucugcugggacgaacucaccaaacucaucgccuggauguccuccaacaucaccuccgaacaaguccgcaccaucaucgucaaccacgucaacgacaccuggggccucaaaguccgccaaucccucugguuccaccucuccugccucaccuucggccaacacaccguccaagaauuccucgucuccuucggcgucuggauacgcacacccgcccccuaccgcccccccaacgcccccauccucuccacccucccagaacacaccgucaucugc

SEQ ID NO: 2331 - RNA, 303 nt, Artificial Sequence
  derived and/or modified CDS sequence (opt11) from Japanese encephalitis virus__Cterm-JEV/JEV
gggagcacgcucgggaaagcguucucgaccacgcucaagggcgcgcaaaggcuagcggccuugggcgauaccgcgugggauuucgggagcauaggcggggucuuuaacucgaucgggcgcgcgguccaucaaguguucgggggcgcguucaggaccuuguucgggggcaugagcuggaucacgcaagggcucaugggcgcgcucuugcucuggaugggggucaaugccagggacaggagcauagccuuggccuuucuagcgaccgggggcgugcucguguucuuggccacgaacgugcacgcg

SEQ ID NO: 2332 - RNA, 15 nt, Artificial Sequence
  derived and/or modified CDS sequence (opt11) from Artificial__MKRKK
augaagaggaagaag

SEQ ID NO: 2333 - RNA, 9 nt, Artificial Sequence
  derived and/or modified CDS sequence (opt11) from Artificial__Linker(SGG)
agugggggc

SEQ ID NO: 2334 - RNA, 27 nt, Artificial Sequence
  derived and/or modified CDS sequence (opt11) from Artificial__Linker(G4SG4)
ggggggggggggagugggggggggggg

SEQ ID NO: 2335 - RNA, 51 nt, Artificial Sequence
  derived and/or modified CDS sequence (opt11) from Foot-and-mouth disease virus__F2A/P2A
aacuucgaccuccucaaacucgccggcgacgucgaauccaaccccggcccc

SEQ ID NO: 2336 - RNA, 300 nt, Artificial Sequence
  derived and/or modified CDS sequence (opt11) from DENV-1 CYD23__C
augaacaaucaaaggaaaaagaccgcgcgcccgagcuuuaacaugcucaagcgcgcgcgcaaucgcgugagcacggucucgcaauuggccaagcgcuuuagcaagggccugcucucgggccagggcccgaugaagcucgugauggcguucauagccuuucucagguucuuggccauacccccgaccgcgggcauacucgcgcgcuggggcucguucaagaaaaauggcgcgaucaaggucuugcgcggguucaagaaagagaucucgaacaugcucaauaucaugaacaggcgcaggaaa

SEQ ID NO: 2337 - RNA, 342 nt, Artificial Sequence
  derived and/or modified CDS sequence (opt11) from DENV-1 CYD23__C-SSc
augaacaaucaaaggaaaaagaccgcgcgcccgagcuuuaacaugcucaagcgcgcgcgcaaucgcgugagcacggucucgcaacuggccaagcgcuuuagcaagggccugcucucgggccagggcccgaugaagcucgugauggcguucauagccuuucucagguucuuggccauacccccgaccgcgggcauacucgcgcgcuggggcucguucaagaaaaauggcgcgaucaaggucuugcgcggguucaagaaagagaucucgaacaugcucaauaucaugaacaggcgcagaaaaucggucacgauguugcucaugcucaugcccacggccuuggcc

SEQ ID NO: 2338 - RNA, 273 nt, Artificial Sequence
  derived and/or modified CDS sequence (opt11) from DENV-1 CYD23__pr
uuccaccucaccacccgcggcggcgaaccccacaugaucgucuccaaacaagaacgcggcaaaucccuccucuucaaaaccuccgccggcgucaacaugugcacccucaucgccauggaccucggcgaacucugcgaagacaccaugaccuacaaaugcccccgcaucaccgaagccgaacccgacgacgucgacugcuggugcaacgccaccgacaccugggucaccuacggcaccugcucccaaaccggcgaacaccgccgcgacaaacgc

SEQ ID NO: 2339 - RNA, 225 nt, Artificial Sequence
  derived and/or modified CDS sequence (opt11) from DENV-1 CYD23__M
uccgucgcccucgccccccacgucggccucggccuagaaacccgcaccgaaaccuggauguccuccgaaggcgccuggaaacaaauccaacgcgucgaaaccugggcccuccgccaccccggcuucaccgucaucgcccucuuccucgcccacgccaucggcaccuccaucacccaaaaaggcaucaucuucauccuccucaugcucgucacccccuccauggcc

SEQ ID NO: 2340 - RNA, 498 nt, Artificial Sequence
  derived and/or modified CDS sequence (opt11) from DENV-1 CYD23__prM
uuccaccucaccacccgaggcggcgaaccccacaugaucgucuccaaacaagaacgcggcaaaagccuacucuucaaaaccuccgccggcgucaacaugugcacccucaucgccauggaccuaggcgaacuaugcgaagacaccaugaccuacaaaugcccccgcaucaccgaagccgaacccgacgacgucgacugcuggugcaacgcaaccgacaccugggucaccuacggcacaugcucccaaaccggcgaacaccgccgagacaaacgauccgucgcccucgcaccccacgucggccucggccuagaaacccgaaccgaaaccuggauguccuccgaaggcgccuggaaacaaauccaacgcgucgaaaccugggcccuccgccaccccggcuucaccguaaucgcccucuuccucgcccacgccaucggcaccucaaucacccaaaaaggcaucaucuucauccuacucaugcucgucacccccuccauggcc

SEQ ID NO: 2341 - RNA, 1485 nt, Artificial Sequence
  derived and/or modified CDS sequence (opt11) from DENV-1 CYD23__E
augcgaugcgucggcauaggaagcagggacuucguagaaggccuaagcggagcaacgugggucgacguaguccuagaacacggcagcugcguaacaacaauggcaaaagacaaaccaacccuagacauagaacuccugaaaacagaagucaccaacccagccguacuacgaaaacuaugcauagaagcaaaaauaagcaacacgaccaccgacagccgaugccccacccaaggagaagccacccuaguagaggaacaagacgccaacuucguaugcagaagaacauucguagaccgaggauggggaaacggcugcgggcuauucggaaaaggaagccucauaaccugcgcuaaauucaaaugcguaaccaaacuagaggggaaaauaguccaauacgaaaaccucaaauacagcguaaucguaacaguucacacaggagaccaacaccaaguaggcaacgaaagcacagaacacggaacaacagcaacgauaacgccccaagcccccacaacagaaauacaacuaacagacuacggagcccugacacucgacugcagccccagaacaggccuagacuucaacgaaaugguacugcugacaaugaaagagaaaagcuggcuaguacacaaacagugguuccuagaccugccacuccccuggacaagcggagcaagcaccucacaggaaaccuggaaccggcaggaccuccuagugacauucaaaacagcacacgccaagaaacaagaagucgucguccuaggcagccaagaaggggcaaugcacaccgcacuaacaggcgcgacagaaauacaaaccuccgggacgacaacgauauucgcaggccaccucaaaugccgccucaaaauggacaaacucaccuuaaaaggcaugagcuacgucaugugcacaggaucauucaaacuggaaaaagaaguagcagaaacccaacacggcacaguccuaguccaaaucaaauacgaaggaacagacgccccaugcaaaauacccuucaguacacaagacgaaaaaggcguaacacaaaacggcagacucaucaccgcaaauccgauagucaccgacaaagaaaagcccguaaacauagaagcagagccaccguucggcgaaagcuacaucguaauaggggccggcgaaaaagcccuaaaacucagcugguucaagaaaggaagcuccaucggcaaaauguucgaagccacggccagaggcgcacgccgaauggccauccuuggggacaccgcaugggacuucggauccaucggcggaguguucaccagugucggaaagcuaguacaccaaaucuucggaacagcguacggcgugcuauucagugggguaagcuggacgaugaaaaucgguauagguguccuacucacguggcuaggacucaacuccaggaguaccagccugagcaugaccugcaucgcaguaggacucgucacgcuguaccuaggagugaugguccaagcc

SEQ ID NO: 2342 - RNA, 1983 nt, Artificial Sequence
  derived and/or modified CDS sequence (opt11) from DENV-1 CYD23__prME
uuccaccucaccacccgcggcggggaaccccacaugaucgucucaaaacaggaacgaggcaaaagccuacucuucaaaacauccgcaggcgucaacaugugcacacuaaucgcaauggaccugggagaacuaugcgaagacaccaugaccuacaagugcccuagaauaacggaagcagaaccagacgacgucgacugcuggugcaacgcaaccgacaccugggucaccuacggaaccugcucacagacaggcgaacacagacgagacaaacgaagcguggcgcuagccccacacgucggccugggauuagaaacuagaacggaaacauggauguccucggaaggcgccuggaaacaaauacagagagucgagaccugggcacucagacaccccggauucacaguaauagcacucuuccuggcccacgccauagggaccagcaucacacaaaaaggaaucaucuucauccucuuaaugcucguaacuccgucaauggcgaugcgcugcgucggaauaggauccagagacuuugucgaaggacuaucuggcgcaacauggguagacgucguccuagaacacggcucuugcgucaccacaauggccaaagacaaacccacacucgacauagaacuccucaaaacagaaguaacaaacccagccguacuccgcaaacucugcauagaagccaaaaucagcaacaccacaaccgacucccguugccccacacaaggggaagccacacucgucgaagaacaagacgccaacuucgucugccgccgcaccuucgucgacaggggcuggggaaacggcugcggccuuuucggaaaaggaucacuaauaaccugcgcgaaauucaaaugcgucaccaaacuagagggaaagaucguccaauacgagaaccuaaaauacagcguuauuguaacaguacacacaggagaccaacaccaaguaggaaacgaauccaccgagcacggcacuacggcaaccaucaccccucaagcccccaccacagaaauacaacuaaccgacuacggcgcccugacacuagacugcucacccagaacaggacucgacuucaacgaaaugguccuacuaaccaugaaggaaaaauccuggcugguacacaaacagugguucuuggaccuaccgcuucccuggaccagcggcgccuccacaagccaagagacauggaaccgccaagaccuccuaguaacauucaaaacggcccacgcaaagaaacaagaaguggugguucucggcucgcaggaaggagcaaugcacacggcccuaacgggagcgaccgaaauacagaccuccgguaccaccacaaucuucgccggacaccuaaaaugccgacucaaaauggacaaauuaacccugaaagggauguccuacgucaugugcaccggcuccuucaaauuagaaaaagaaguagcagaaacgcaacacggcaccguccuaguccaaaucaaauacgaaggaaccgacgcaccaugcaaaaucccguucucaacccaagacgaaaaaggaguaacacaaaacggacgccucaucacggccaaccccaucgugacagacaaagaaaaacccguaaacaucgaagcggaaccucccuucggcgaaucauacauaguaauaggagcaggagaaaaggcccucaaacuaagcugguucaaaaagggaagcucaauaggcaaaauguucgaagcaacagccaggggcgcccgcagaauggcaauccucggcgacaccgcaugggacuucggauccauagguggggucuucaccagcguugggaaguuaguacaccaaauauucggcacagccuacggaguccuauuuagcggcguaucauggacgaugaaaaucggaauaggagugcuccugaccuggcugggacugaacagcaggagcacgagccuaucaaugacaugcauagcgguaggccucguaacgcuauaccucggcgucaugguacaagca

SEQ ID NO: 2343 - RNA, 2025 nt, Artificial Sequence
  derived and/or modified CDS sequence (opt11) from DENV-1 CYD23__SSc-prME
ucugucaccaugcuacucaugcucaugccgaccgcccuagccuuucaccucaccacacgcggaggggaaccacacaugaucgucucaaaacaagaacggggaaaaucccuccucuucaaaacauccgccggcguaaacaugugcacucucaucgccauggaccugggugaacucugcgaagacaccaugaccuacaaaugcccccgcauaacagaagcagaacccgacgacgucgacugcuggugcaacgccaccgacaccugggucacguacggaacaugcucacaaaccggcgaacaccgucgcgacaaacgaagcgucgcccucgccccacacgucggccuagggcuagaaacacggaccgaaaccuggaugagcuccgaaggagccuggaaacaaauccagcgcguggaaacaugggcccuaagacaccccggauucacaguaaucgcccucuuccucgcacacgccauuggcacuucuaucacacaaaaaggcaucaucuucauacuccuuaugcucguaacccccuccauggccaugcgcugugucggaaucggcagccgcgacuuugucgaaggccucaguggagccacaugggucgacguaguccucgaacacggaagcugcguaaccaccauggcaaaagacaaacccacccuggacaucgaacuacuaaaaaccgaaguaaccaaccccgccguacuaaggaaacucugcauugaagccaaaaucagcaauacaacgacagacucccggugccccacucagggcgaagcuacgcuaguggaagaacaagacgcgaacuucguaugcagacgcacauucguugacagaggauggggcaacggcugcggccuguucggcaaaggcagccucauaaccugcgcuaaauuuaaaugcguaacaaaacuggaaggcaagaucguccaauacgaaaaccucaaauauaguguaauaguaaccguucacaccggagaccagcaucaagucggcaacgaguccaccgagcacggaaccaccgccaccaucacgccccaggcccccaccaccgaaauacaacucacggacuauggagcccucacccuagacugcagcccccgcaccggccucgacuucaacgaaaugguacuacuaaccaugaaagagaaaagcuggcucguccacaaacaaugguuccuggaccuaccacuaccauggaccagcggcgccagcacaucccaagaaacauggaacagacaggaccuacucgucacguucaaaaccgcccacgccaagaaacaagaagucgucguacuaggcucgcaagaaggcgccaugcacacagcacucaccggcgccaccgaaauccaaaccucaggcaccaccacaauauucgcaggccaccugaaaugucgccucaaaauggacaaacucacacucaagggcaugagcuacgucaugugcacaggcagcuucaaacucgagaaagaaguagccgaaacacaacacggaacaguccuuguccaaauaaaguacgaaggaacggacgccccaugcaaaaucccauucucaacccaggacgaaaaaggcgugacucaaaacggacgccuaauaacggccaacccgauagucacagacaaagaaaaacccgugaacaucgaagcggaaccaccguucggcgagaguuacauagugaucggagcaggagaaaaggcccuaaaacucagcugguucaagaaaggcuccuccaucggaaaaauguucgaagccacggcacgcggugcccgaagaauggccauacuaggcgacaccgcgugggacuucgguuccaucggaggcgucuucaccaguguaggcaagcuaguccaccaaauauucggcaccgcauauggaguacuauucucaggaguaagcuggacaaugaaaaucggcauaggagugcuacuaacguggcuaggacuaaacucaagaagcaccagcuuaagcaugacaugcaucgcaguaggccucgucacacucuaccuagguguaaugguacaagca

SEQ ID NO: 2344 - RNA, 2325 nt, Artificial Sequence
  derived and/or modified CDS sequence (opt11) from DENV-1 CYD23__C-prME
augaacaaccaacggaagaaaaccgcccgcccgagcuucaacaugcucaaacgagcaagaaaccgaguaagcaccguaucccaacucgccaaacgauucagcaaaggccuacuguccggccaaggcccaaugaaacucgucauggcauucaucgccuuccuacgauuccucgcaaucccucccacugcaggcauccucgcacgauggggcucauucaagaaaaauggagccauuaaaguccuacgcggauucaaaaaggaaaucucgaacauguuaaacauaaugaacaggcgccgcaagagcgucaccaugcuccuuaugcucaugccaacggccuuagccuuucaccuuaccacccgcggaggagagccccacaugauagucucaaaacaagagcgagguaaaagccuacucuucaaaacguccgccggcguaaacaugugcacacuaauagccauggaucucggugagcuuugcgaagacaccaugacauacaaaugcccccgcauaacagaagccgaacccgacgacgucgacugcuggugcaacgccaccgauacaugggucacuuacggaaccugcucccaaaccggcgaacacagacgagacaaaaggucaguagcccuagccccacacgugggccuaggacucgaaacacgcacggaaacguggauguccuccgaaggggccuggaaacaaauccaacgaguggaaaccugggcacugagacaccccggcuucacaguaaucgcacucuuucuagcacaugcaauaggcaccucaaucacacaaaaaggcauaaucuucauccuucucaugcuugucacacccuccauggccaugcgauguguagggauaggaucccgagacuucguagaaggacucagcggagcaaccugggucgacguagugcucgaacacggcuccugcgucacgacgauggcaaaagacaaaccaacccucgacauagaacugcuuaaaacggaggucaccaaccccgccguacucaggaagcucugcaucgaagccaaaauaagcaacacgaccaccgacagccgaugcccaacccagggagaagcgacccuaguagaagaacaagaugccaacuucgucugccgacgcaccuucgucgaccgaggauggggcaacggaugcggacuauucggaaaaggcagccugauaaccugcgccaaauucaaaugcgugacaaaacuagaagggaaaaucguccaauacgagaaccuaaaauauuccguaaucguaacaguccacacaggcgaccaacaccaggucggaaacgaaagcaccgaacacggcaccacggccaccaucaccccacaagccccuacaaccgaaauacagcuaacagacuacggagcccucacauuggacugcaguccccguaccggccuggacuuuaacgaaaugguacuccucaccaugaaggagaaauccuggcuaguacauaaacaaugguuccucgaccucccccuacccuggacauccggggcaucgacaucacaagagacauggaaccgccaagaucuccucgucaccuucaagaccgcacacgcaaagaaacaagaaguuguaguccuuggaagccaagaaggcgcaaugcacacagcacucaccggagccaccgagauccaaaccucaggaacaacgaccauauuugcgggacaccucaaaugccgacucaaaauggacaaacuaacacuaaaaggcaugucauacguaaugugcacaggcuccuucaaacucgagaaggagguggcagaaacccagcacgggaccguccucguacagauaaaauacgaaggcaccgaugcccccugcaagauccccuuuagcacacaagacgaaaaaggaguaacucaaaacggacgccuaauaacagccaaccccaucgucaccgacaaagagaaacccgugaacauagaagcagagccaccguucggcgaaucauacauagugauaggagccggagaaaaagcccuaaaacucagcugguucaagaaaggaucaucaaucggcaaaauguucgaggcaacagcgcgcggagcccggagaauggcaaucuuaggcgacacugccugggacuucggcagcaucggcggagucuucaccucggucggcaaacuuguacaccaaauuuucgggaccgcuuacggaguccuauucucaggcguaagcuggacaaugaaaaucgguaucggcguacuccuaacauggcucgggcuaaacagucgcagcacuagcuuaagcaugacaugcaucgccguuggccucgugacacuguacuuagguguaaugguacaggca

SEQ ID NO: 2345 - RNA, 45 nt, Artificial Sequence; identical to SEQ ID NO: 1585
  derived and/or modified CDS sequence (opt11) from DENV-1 CYD23__SSc

SEQ ID NO: 2346 - RNA, 57 nt, Artificial Sequence
  derived and/or modified CDS sequence (opt11) from DENV-1 CYD23__SSopt
augaaacgcaagaaaucggucacgaugcugcucaugcucaugcccacggcccuggcc

SEQ ID NO: 2347 - RNA, 57 nt, Artificial Sequence
  derived and/or modified CDS sequence (opt11) from DENV-1 CYD23__SSm
augacccaaaaaggcaucaucuucauccuccucaugcucgucacccccuccauggcc

SEQ ID NO: 2348 - RNA, 1488 nt, Artificial Sequence
  derived and/or modified CDS sequence (opt11) from DENV-1 CYD23__E
augcgcugcguaggaauagggagcagggacuucgucgaaggccugaguggggcaaccuggguggacgucguccuagaacacggaagcugcgugaccaccauggcaaaagacaaacccacacucgacauagaacuacucaaaaccgaaguaacaaauccagccguccuacgaaaacugugcaucgaagccaaaaucucaaacacaacaaccgacagccggugccccacacaaggagaagccacccuaguagaagaacaagacgccaacuucguaugucgacgcacguucgucgaccgcggcuggggcaacggcugcggccucuucgggaaaggaagccuaauaacaugcgcaaaauuuaaaugcgucacgaaacuagaagggaaaauaguacaauacgaaaaccucaaauacagcguaauaguaaccguccacacaggggaccagcaccagguaggaaacgaaucaaccgagcacggaaccacagccaccauaacuccccaagcacccacaacagaaauccaacucaccgacuacggggcucucacccucgacugcucaccgcgaacaggccuggacuucaacgaaaugguacuccuaaccaugaaagagaaaagcuggcugguccacaaacaaugguuccuagaccuaccgcuaccauggacaagcggagccuccaccagccaagaaaccuggaacagacaagaccuccuagucacauucaaaaccgcacacgcaaagaaacaagaagucgucguccuagggagccaagaaggcgcaaugcacaccgcacugacgggagcaacagaaauccaaacauccggaacaaccacaauauucgccggacaccuaaaaugccgccuaaaaauggacaaacuaacacugaaaggcaugagcuauguaaugugcacaggcucguucaaacucgaaaaagaagucgccgaaacacaacacgggacaguccuaguacaaaucaaauacgagggcaccgacgcgcccugcaaaauaccauucagcacccaggacgagaaaggcgucacacaaaacggacgccuaaucacagccaacccaauaguaacagacaaagagaaacccguaaacauagaagcagaaccaccauucggcgaauccuacaucguaauaggcgcgggagaaaaagcccuaaaacuaagcugguucaagaaagguuccagcaucggcaaaauguucgaagcgaccgccaggggagcacgacggauggccauccuaggagacaccgccugggacuucggaagcauaggcggagucuucacaucagucggaaagcuaguccaccaaaucuucggaaccgcauacggaguccucuucucgggagugagcuggaccaugaaaauaggcauaggaguacuacuaacauggcuuggccugaacagcagauccacaucccugagcaugaccugcaucgcagucggacucgucacccucuaccucggcgucaugguccaagcauaa

SEQ ID NO: 2349 - RNA, 1182 nt, Artificial Sequence
  derived and/or modified CDS sequence (opt11) from DENV-1 CYD23__EdelTM-variant (aa1-394)
augcgcugcgucggcaucggcucacgcgacuucgucgaaggacuauccggcgccaccugggucgacgucguacucgaacacggcucgugcgucaccacaauggccaaagacaaaccaacacucgacauagaacuccucaaaacagaagucaccaacccggcaguccuacgcaaacucugcaucgaagccaaaauauccaacaccacaaccgacuccagaugccccacccaaggcgaagccacacucguagaggaacaagacgccaacuucgucugccgccgcacauucguagaucgcggcuggggcaacggcugcggccucuucggcaagggcagccugaucacaugcgcaaaauucaagugcgucacaaaacuugaaggaaaaauaguccaauacgaaaaccucaaauacucaguaauugugaccguccacaccggcgaccaacaccaaguaggaaacgaaagcacagaacauggcacgacagccacgaucaccccacaagcccccacaacagaaauccaacucacagacuacggcgcacuaacccucgacugcucgcccagaaccggccuagacuucaacgaaaugguccuacuaaccaugaaagagaaaagcuggcuaguccacaaacaaugguucuuagaccuaccacuccccuggaccuccggcgccagcaccagccaagaaaccuggaaccgccaagaccuccuagucacauucaaaaccgcacacgccaagaaacaagaagucgucguccucggaucccaagaaggcgccaugcacaccgcccugacaggcgccaccgaaauccaaaccagcggcaccaccacaaucuucgccggacaccucaaaugccgccuaaaaauggacaaacuaacccuaaagggcaugucguacguaaugugcaccggcucauucaagcucgaaaaagaaguagccgaaacccagcacggaacgguccuaguccaaaucaaguacgaaggcacagacgcccccugcaaaauccccuucuccacacaggacgaaaaaggaguaacccaaaacggccgccucauuacagccaaccccaucgucaccgacaaagaaaaacccguaaacauagaagcagaaccacccuucggcgaaagcuacaucgucauaggcgccggcgaaaaagcccucaaacuaucaugguucaagaaa

SEQ ID NO: 2350 - RNA, 1275 nt, Artificial Sequence
  derived and/or modified CDS sequence (opt11) from DENV-1 CYD23__EdelTM-variant (aa1-424)
augcgaugcgucggaaucggcagucgcgacuucguagaaggacucagcggagcgaccugggucgacguaguccuagaacacgggagcugcguaaccaccauggccaaagacaaacccacccucgacauagagcuccucaaaacagaagucacgaacccagccguacuccgaaaacuaugcaucgaagccaagaucagcaacacaaccaccgacucacgcugcccaacccaaggcgaagccacccuaguagaagaacaagacgcaaacuucgucugccgacgcaccuucguagaccgcggcuggggcaacggcugcgggcuauucggcaaaggcucacuaaucacaugcgccaaauucaaaugcguaaccaaacucgaaggcaaaaucguccaauacgaaaaccucaaauacuccguaaucguaaccguccacaccggcgaccagcaccaaguaggaaacgaaagcaccgaacacggcaccaccgcaaccaucacaccccaagcccccacgaccgaaauccaacugaccgacuacggagcccuaacgcucgacugcagcccccgcacaggccucgacuucaacgaaaugguccuccuaacgaugaaagaaaagagcugguuaguccacaaacaaugguuccucgaccucccccuacccuggacaagcggcgccuccaccagccaagaaacauggaaccgccaagaccuacuuguuaccuucaaaaccgcccacgcuaagaaacaagaaguggucguacuaggcagccaagaaggcgcaaugcacaccgcccugacaggggccacagaaauccaaacauccggaaccaccaccauuuucgccggccaccuaaaaugccgccugaaaauggacaaacucacccugaaaggaaugucauacguaaugugcaccggauccuucaaacuagaaaaagaaguagcagaaacacaacacggaaccguccuaguccaaauaaaauacgaaggcacagacgcccccugcaaaauccccuucuccacacaagacgaaaaaggcguaacccaaaacggcagacucauaacggccaaccccauaguaaccgacaaagaaaaacccgucaacauagaggccgaaccacccuucggcgaaucauauauagucaucggcgcaggagaaaaagcccuaaaacuauccugguucaagaaaggauccucaaucggcaaaauguucgaagcaaccgcacgaggagccagacgcauggccauccucggcgacacagccugggacuucggcucauaa

SEQ ID NO: 2351 - RNA, 1266 nt, Artificial Sequence
  derived and/or modified CDS sequence (opt11) from DENV-1 CYD23__EdelTM-variant (aa1-421)
augagaugcguaggcaucggaucccgcgacuucgucgaaggccucuccggagccacaugggucgauguaguacuagaacacggauccugcguaacaaccauggccaaagacaaacccacccuugacaucgaacuccucaaaacagaagucaccaaccccgccguacuccgcaaacuaugcaucgaagccaagaucuccaacacaaccacagacucccgaugcccaacacaaggcgaagccacccuagucgaggaacaggacgccaacuucgucugccgcagaaccuucguagacagaggauggggcaacggaugcggccuauucggaaaaggcucacucauaaccugugccaaauucaaaugcgucaccaagcucgagggcaaaaucguucaauacgaaaacuuaaaauacucagucaucgucaccguacacaccggcgaccaacaccaagucggcaacgaauccaccgaacacggcaccacagccaccaucacaccacaagccccaacaaccgaaauccagcucacggacuacggagcacuaacacucgacugcagcccccgcaccggacuugauuucaacgaaaugguacuccuaaccaugaaagaaaaauccuggcuaguccacaagcaaugguuccucgaccucccacuccccuggaccuccggcgccagcaccagccaagaaacauggaacagacaagaccuccucgucacauucaaaacagcacacgccaagaaacaagaagucguaguccucggcucccaagagggcgccaugcacaccgcacucacaggcgccaccgaaauacaaaccagcggcacaacaaccaucuucgcagggcaccuaaaaugccgccuaaaaauggacaaacucacccucaaaggcauguccuacgucaugugcaccggcagcuucaagcucgaaaaagaagucgccgaaacccaacacggaacaguccuaguccaaaucaaauacgaaggaacagacgcacccugcaaaauacccuucuccacacaagacgaaaaaggcgucacccaaaacggccgccuaauaacagcaaaccccauaguaaccgacaaagaaaaacccgucaacaucgaggcagaaccaccauucggagaaucauacaucguaaucggcgccggcgaaaaagcacucaaacucagcugguucaagaaaggcuccuccauaggaaaaauguucgaagccaccgcccgcggcgcccgacgcauggccauccuaggagacacagcaugggacuaa

SEQ ID NO: 2352 - RNA, 2031 nt, Artificial Sequence
  derived and/or modified CDS sequence (opt11) from DENV-1 CYD23__SSc-prME
augagcgucacgaugcuacucaugcucaugccuaccgcacuagccuuccaccucaccacaagagguggagaaccacacaugaucgucagcaaacaagagaggggaaaaucccuccuuuucaaaacaagugccggagucaacaugugcacccucauugccauggaccugggcgagcugugcgaagauaccaugaccuacaaaugcccccgcauaaccgaagcagagccagacgacgucgacugcuggugcaacgcaaccgacacauggguaaccuacggcacaugcagccaaaccggcgaacacagacgcgacaaaagaagcgucgcccucgcaccacacgucggccuuggacucgaaacgcgaacggaaaccuggauguccagcgaaggcgcauggaagcaaauacaacgcguggaaacgugggcacuacgccacccaggauucaccgucaucgcacucuuccuggcgcacgcaaucggaacuucaauaacacagaaaggaaucaucuucauacuacucauguuagucaccccgagcauggccaugcggugcguaggaauagggagccgcgacuucguugaaggacucucaggagccacaugggucgacguaguccuggaacacggaucaugcgugacgacaauggccaaagacaaaccaacccuagacauagaacuccuaaaaacagaagucacaaaccccgcaguccuccgcaaacugugcauagaagcaaaaauaagcaacaccaccacagacuccaggugccccacccaaggagaagccacccuaguggaagaacaagacgccaacuuugugugccgacgaacauucguagaccgcggcuggggaaacggaugcggacucuucggaaaaggaagccuaaucacaugcgcaaaguucaagugcguaacaaaacuggaaggaaaaauaguccaauacgaaaaccuaaaauacagcguaauaguaacaguccacaccggagaccaacaccaagucggaaacgaguccacagaacacgggacaaccgcaacaaucacgccacaggcacccaccacagaaauccaacucacagacuacggagcccucacccuagacugcucaccacgaacaggacuagacuucaacgagaugguacuccuaaccaugaaagaaaagucauggcuaguccacaaacagugguuccucgaccuaccccucccauggacauccggagccagcacaucacaagaaacauggaacagacaagaccuccuagucacauucaaaacagcacacgcaaagaaacaagaagucgugguacuuggaagccaagaaggcgccaugcacacagcacuaaccggagcgaccgaaauacagacaagcggcaccaccacaaucuucgcaggccaccuaaaaugccggcuaaaaauggacaagcuaacacucaagggaaugaguuacgucaugugcaccggcuccuuuaaacuagaaaaagaaguagcagaaacacaacacggcaccguccuaguacaaauaaaguacgagggaacggacgcccccugcaaaaucccauucagcacacaggacgaaaaaggggucacucaaaacggacgacuaaucaccgcaaaccccaucgucaccgacaaagaaaagccgguaaacauagaagccgaaccgccguucggcgaaagcuacauaguaaucggggccggagaaaaagcccugaaacuaagcugguucaagaaaggcucauccaucggaaaaauguucgaagcaaccgcccgcggcgcccgcaggauggccauacucggcgacacagcgugggacuucggguccaucggcggcguauucaccucaguagggaagcuagugcaccaaaucuucgggacagcauacggcguccucuucucuggcguaagcuggaccaugaaaaucggcaucggcgugcuacugaccuggcucggacuaaacucgcgaagcaccucccugagcaugaccugcaucgcagucggacucgucacccuauaccuaggcgugaugguacaagcauag

SEQ ID NO: 2353 - RNA, 2031 nt, Artificial Sequence
  derived and/or modified CDS sequence (opt11) from DENV-1 CYD23__SSc-prME(F108S)
augucaguaacaaugcuccucaugcuaaugcccacggcacucgcauuccaccuaaccacacgcggaggcgaaccccauaugaucguauccaaacaagaacgcggcaaaagccuacucuucaagacaagcgcaggcgucaacaugugcacauugaucgcaauggaccucggcgaacucugcgaagacaccaugacguacaaaugcccacgcaucacagaagcggaaccagacgacguagauugcuggugcaacgcaaccgacacgugggucacauacggaaccugcucacagacaggcgaacaccgccgagacaagagaagcguggcacucgcgccccacguaggccucggccuagaaacaagaacagaaacauggaugucuuccgaaggcgccuggaaacaaauccagcgagucgaaacaugggcccuccgccacccgggauuuacaguaaucgcccuauuccuagcgcacgccauagggacaagcauaacccaaaaaggcauaauauucaucuugcuaaugcucguaacccccuccauggccaugagaugcgucggaaucggcagcagagacuucguagaaggauugucgggagcaaccuggguagacguaguccuugaacacggcagcugcgugacaacaauggcgaaagacaaaccaacccuagacaucgaacuacucaaaacagaaguaacaaaccccgcagugcuacgcaaacucugcaucgaagcaaaaaucagcaacaccaccacagacuccagaugucccacccaaggugaggccacgcucguagaagaacaagacgccaauuucgucuguagacgcacauucgucgacagaggcuggggcaacggcugcggccuaagcgggaagggcucccucauaaccugcgcaaaauucaaaugcguaaccaaacucgaaggaaaaaucguacaguacgaaaaccucaaguacucagucaucgucaccguacacacaggcgaccaacaccaagucggaaacgaaagcaccgagcacggcaccacagccaccaucacaccacaagccccaacuaccgaaauccaacugacagacuacggagcacuaacacucgacugcagcccacgaacaggacuugauuucaacgagauggugcuacucacuaugaaagagaaaagcuggcucgugcacaaacaaugguuccuagaucuaccccucccguggacaagcggggccucaaccagccaggagacguggaaccgccaagaccuucuaguaacauucaagaccgcccacgccaagaaacaagaagugguagugcucggcucccaggaaggagccaugcacacagcacuaacaggagcaaccgagauccaaacaucaggcaccaccaccauauucgccggacaccuaaaaugccgauugaaaauggacaaacucacgcucaaaggaaugagcuaugucaugugcacaggauccuucaaacucgagaaagaagucgcagaaacgcaacacggaacaguccucguccaaauaaaauacgaaggcaccgacgccccaugcaaaauacccuucaguacacaagacgaaaaaggaguaacacaaaacgggcgccucauaacagccaaccccauagucaccgacaaagaaaaaccagucaauaucgaggcggaacccccguucggagaaagcuacauagucaucggcgcaggagaaaaagcccucaaacuaagcugguucaagaaaggaagcucaaucggaaaaauguucgaggcaacagcaagaggcgcacgccgcauggcaauccuaggcgacaccgcaugggacuucggcagcauaggaggaguauucaccucggucggcaaacucguccaccaaaucuucggaaccgccuacggagugcucuuuucgggcguaagcuggaccaugaaaauaggaauaggcguucuacugaccuggcuuggacucaacagccgcucaacaagucugagcaugaccugcauagcagucggacucguaacacuguaccucggcgucauggugcaagccuaa

SEQ ID NO: 2354 - RNA, 2031 nt, Artificial Sequence
  derived and/or modified CDS sequence (opt11) from DENV-1 CYD23__SSc-prMEdelstem_TM-JEV
auguccgucaccaugcuacuuaugcucaugccaaccgcccuagccuuccaccugacuacccggggcggcgaaccacacaugaucgucuccaaacaagaaaggggcaagucacuccucuucaaaacaagcgccggcgucaacaugugcacccucauagccauggaccugggagaacucugcgaagacaccaugacauauaagugccccagaaucacagaggccgaaccagacgacgucgacugcuggugcaacgccaccgacacauggguaaccuacggcacaugcagccaaacaggagagcacaggcgugauaaaagaagcguagcccuagcuccacacguaggccugggccucgaaacaagaacagaaaccuggaugucuucagaaggggccuggaaacaaauccaacgaguagaaacaugggcgcuccgacacccgggcuucaccgucaucgcccucuuccuagcccacgcaaucggaaccuccauaacccagaaaggcaucauauucauccuccucaugcuagucacccccagcauggccaugcgaugcgucggcaucggcagcagggacuucgucgaaggccucucaggagccaccuggguggacguaguccucgaacacggauccugcgucaccacaauggccaaagacaaaccaacccuagacaucgaacuccucaaaaccgaagucacaaaccccgcaguucuccgcaagcuaugcaucgaagcgaaaaucucaaacacaacaaccgacagccggugccccacccaaggagaagccacccuaguagaagaacaagacgccaauuucgucugcaggcgcacauucgucgaccggggauggggaaacggaugcggcuuauucgggaaaggaucccuaaucacaugcgccaaauucaaaugcgucaccaaacucgaggggaaaaucguacaauacgaaaaccucaaauacuccguaaucgucaccguccacacgggcgaccaacaccaagucggcaaugaaucgacagaacacggcaccacagcaaccaucacaccacaggcaccgacaacagaaauacagcugaccgacuacggagcccuaacccucgacugcucaccaagaaccggcuuagacuucaacgaaaugguccuacuaaccaugaaagagaaaagcuggcuaguacacaaacaaugguuccuagaccucccacucccauggaccucaggagccuccaccucccaagaaaccuggaaccgccaagaccuccucgucacauucaaaacggcccaugccaagaaacaagagguagucguccuagguucgcaagagggagccaugcacacggcccucacuggagccaccgagauccaaaccuccggcacgaccaccauuuucgccgggcaucuaaaaugcagacugaaaauggacaaacuaacccucaaagggaugagcuacgucaugugcacaggaucuuucaaacuugagaaagaaguagcagaaacacaacacggcacgguccuuguccagaucaaauacgaaggaaccgacgcacccugcaaaauccccuuuucuacccaagacgaaaaaggcgucacucagaauggacgccucauaacagccaacccaaucguuaccgacaaagaaaagcccguaaacaucgaagcagaaccgccauucggcgaauccuacaucguaauaggcgcaggagaaaaagcccuaaaauuaagcugguucaagaaaggcagcacccuaggaaaagcauuuucaaccacccucaaaggcgcacaaagacucgccgcccugggcgacaccgcaugggacuucggcagcauaggaggcguauucaacuccaucggccgcgccgugcaccaagucuucggaggagcauucagaacccucuucggaggcaugagcuggaucacacaaggacuaaugggugcccuacuacucuggaugggggucaacgcccgagacagaagcauagcccucgccuuucucgcaaccggcgguguccuaguauuccuagccacgaacguacacgccuaa

SEQ ID NO: 2355 - RNA, 2379 nt, Artificial Sequence
  derived and/or modified CDS sequence (opt11) from DENV-1 CYD23__C-P2A-SSc-prME
augaauaaccagcgaaagaaaacagccagacccagcuucaacaugcuaaaacgagccagaaacagagucagcacgguuagccaacuagcaaaacgguuuagcaaaggccuccucagcggacagggccccaugaagcuagucauggcauucauagcauuccuccgauuccuagcaauaccaccaacagccggcauucucgcacgauggggcagcuucaagaaaaacggagcaaucaaaguacucagaggauucaagaaagagauuuccaacaugcugaacauaaugaaccgacgacgcaaaaacuucgaccuccuaaaacuagcaggagacguggaaaguaacccaggcccaagugucacaaugcuacucaugcuaaugccaacagcacuugccuuccaccugaccacgcggggcggggaaccacacaugauaguaagcaaacaagaaagaggaaagagccuacucuuuaaaacaagcgccggcgucaacaugugcacgcucaucgcaauggaccucggggaacucugcgaagacacaaugaccuacaaaugcccccgcauaacggaagcggagccagacgacguggacugcuggugcaacgcaaccgacacguggguaacauacggaacauguagccaaacaggcgagcaccgccgggacaagagaagcgucgcacuggccccucacgucggccucggacuggagaccagaacagagaccuggaugucaagcgaaggagcauggaaacaaauacaacguguagaaacaugggcacuaagacacccaggauuuacugucauagcccucuuccuagcacacgcaauaggaacuuccauaacacaaaaaggaauaauauucauccuccugaugcuggugacuccaucaauggcgaugcgauguguaggcaucggcagcagggacuucguagaaggauuauccggagcaaccugggucgauguaguucucgaacacggaagcugcgucacaaccauggccaaagacaaaccuacgcucgacaucgaacuccucaaaaccgaaguaaccaacccggccguccuaagaaaacucugcauugaagccaaaaucagcaacaccaccaccgacagccgauguccaacucagggagaagcaacacucguagaagaacaggacgccaauuucguaugccgacgcacauucguagacagaggcuggggaaacggaugcggacuauucgggaagggaagccuccucacaugcgcuaaauucaaaugcguuacuaagcuggaagggaaaauaguacaauacgaaaaccugaaguacagcguaaucgucacaguacacacgggagaccaacaccaggugggaaacgaaagcaccgaacacggaacgacggccacaaucacaccgcaagccccaacuaccgaaauacaacucacagacuacggagcacugacacuugacugcuccccgagaacgggccuagacuucaaugaaaugguccuacucacaaugaaagaaaaaucguggcuagugcacaaacagugguuccucgaccucccacucccguggacaagcggcgcaagcaccucacaagaaaccuggaaccgacaagaccuccucguaacauucaaaacggcccacgccaagaaacaagaagucgucguacuaggcagccaagagggugcaaugcacacagcccuaaccggcgcaaccgaaauacaaaccagcggcaccacaaccaucuucgcgggacaccuaaaaugcagacugaaaauggacaaacucacacugaagggcaugagcuacguaaugugcaccggaucauucaaacuagaaaaggaggucgccgagacccaacacggcaccguccuaguacagauaaaauacgaagggacagacgcaccgugcaaaauacccuucuccacacaagacgaaaaaggaguaacccagaacggcaggcugaucacagccaaccccauagucacagacaaagaaaaaccggucaacauagaagccgaaccacccuucggagaaagcuacaucguaauaggagccggagaaaaagcccuuaaacugagcugguucaagaaaggcucauccauaggaaaaauguucgaagccacggcccgaggagcacgaaggauggcgauacugggcgacaccgcaugggacuuuggaaguaucggaggcguguucaccucagucggaaagcuaguccaccaaaucuucggaacagcauacggcguccucuucucgggcguaagcuggacgaugaaaauagguauaggcgugcuccuaacguggcucggacucaacucccgguccacaagccugagcaugacaugcaucgcggucggccucguaacacucuacuugggcgugauggugcaagcauag

SEQ ID NO: 2356 - RNA, 2043 nt, Artificial Sequence
  derived and/or modified CDS sequence (opt11) from DENV-1 CYD23__SSopt-prME(F108S)
augaaacguaagaaaucgguaaccauguugcucaugcucaugcccacagcccucgcguuccaucucacaacaagaggaggagaaccccauaugaucgucucgaaacaagaacgagggaaaagccuacuguucaaaacaagcgccggaguaaacaugugcacacucauagcaauggaccuaggagaacuaugcgaggacacaaugaccuacaaaugcccaaggauaacagaagccgaaccagaugacgucgacuguuggugcaacgccacagacacaugggucaccuacggcacaugcagccaaacaggagaacaccgccgggacaaacggucggucgcccucgcuccccacgucggccucggacucgaaacgcgaaccgaaaccuggaugagcucagagggcgccuggaaacaaauccaaagagucgaaaccugggcgcucaggcacccaggcuucacggucaucgcccuguuccuggcgcacgcuauaggaaccucaaucacucagaaaggcauaaucuucauccuccucaugcucgucaccccgagcauggccaugcgaugcguaggaaucggaagccgagacuucguagaaggacugagcggagccaccugggucgacgugguccuagaacacggaagcugcgucaccacaauggcaaaagacaaaccaacacuagacauagagcuacucaaaaccgaggucacaaacccagcaguacuccgcaaacuaugcauagaagccaaaaucagcaacaccacaaccgacucccgauguccaacccaaggcgaagccacacucgucgaggaacaagaugccaacuucgucugcagacgcaccuucgucgacagaggauggggaaacggcugcggccuauccggcaaaggaucccucauaacaugcgcgaaauucaaaugcgugaccaagcucgaaggaaaaauaguacaauacgaaaaccucaaauacagcgugaucguaacaguccacaccggagaccaacaccaagucggcaacgaauccacagaacacgggaccaccgccacuaucacaccucaagcaccaaccacagaaauacaacucaccgacuacggcgcccucacccuagacugcagcccccgaaccggucuagacuucaacgaaauggugcuucugacuaugaaagagaaaucauggcugguccacaagcaaugguuccucgaccucccacuaccguggaccagcggagccagcaccagccaagaaaccuggaacaggcaagacuugcucgucaccuucaaaacagcacacgcuaagaaacaagaagugguaguccuuggaagccaggaaggagcaaugcacacagcgcuaacaggcgcgaccgagauacaaaccaguggcacaacaacaaucuucgccggccaccuaaagugccgccuaaaaauggacaaacucacacuuaaaggaaugagcuacgugaugugcacaggaucguuuaaacuagaaaaagaggucgcugaaacacaacauggcacgguccuaguccaaaucaaauacgaaggcaccgacgcccccugcaaaauacccuucagcacacaagacgaaaaaggcguuacccaaaacggacgacuaauaacagccaacccaauaguaacggacaaagagaaacccguaaacaucgaggccgaaccacccuucggagaaagcuauaucguaaucggcgccggagaaaaagccuugaagcucucgugguucaagaaaggauccagcaucggaaaaauguucgaagccacagccagaggcgcccgcagaauggcaauccuaggcgacacggcaugggacuucggcagcauagggggcgucuucacaucaguaggcaaauuaguccaccaaauauucggaaccgcauacgggguacuauucagcggaguauccuggacaaugaaaauuggaaucggcguacuccuaaccuggcuaggcuuaaauagccgcagcacaucacuaagcaugaccugcaucgcaguaggccucgucacacuauaccugggaguaaugguccaggcguga

SEQ ID NO: 2357 - RNA, 2043 nt, Artificial Sequence
  derived and/or modified CDS sequence (opt11) from DENV-1 CYD23__SSopt-prME(F96H)
augaaacguaagaaaucggucacaaugcugcucaugcuaaugcccacagcacucgcauuccaccucaccacacguggcggcgaaccacacaugaucguaagcaaacaggaacgaggcaagagccuacuguucaaaaccucagcaggagugaacaugugcacccuaauugccauggaccucggcgaacuuugcgaagauaccaugaccuacaaaugcccacgcaucacagaagcugaaccagacgaugucgacugcuggugcaacgccaccgacaccuggguaacuuacggaaccugcucacaaaccggcgagcacagaagagacaaaagguccgucgcccuagcaccccacgucggccucggccuggaaacgcguaccgaaacauggaugagcucagaaggcgcauggaaacaaauccaacgcgucgaaacaugggcccucagacauccaggcuucacagugaucgcacuauuccucgcccaugcaaucggcaccuccaucacacagaaagguaucaucuucauccuacugaugcuggugacaccgagcauggcuaugcgaugcgucggaauaggcucgagagacuucgucgaaggacuaagcggcgccaccuggguagacguaguccuagaacacggcaguugcguuaccacaauggcaaaagacaaacccacccuagacauagaacuacucaagacagaagucaccaaccccgccguacuccgaaaacuaugcauagaagcaaaaaucagcaacaccacaacugacaguaggugccccacccagggggaggccacacucguagaagaacaggacgcgaacuucguaugccgccgcacccacguagaucgaggaugggguaacggcugcggccuguucggaaaaggcagccucaucacaugcgccaaauucaaaugcguuacaaaacuggaaggcaagauaguccaauacgaaaaccuuaaauacagcguaaucguaaccguccacacaggcgaccaacaccaaguaggaaacgaauccacagaacacggcaccacagcaaccaucacuccccaagccccaaccaccgaaauacagcucaccgacuacggcgcucuaacccucgacugcagcccacgaaccggccucgacuucaacgagaugguacucuugaccaugaaagagaaaucauggcucguacacaaacaaugguuccuagaucuuccccuaccauggaccuccggagccuccaccucccaagaaaccuggaacagacaagaccuccucgucaccuuuaagaccgcccacgccaaaaagcaagaggucgugguccucggcucccaagaaggcgccaugcauacugcacuaaccggagccacagaaauccaaaccagcggcacaaccaccauauucgcuggccaccuaaaaugccgacucaaaauggacaaauuaacccucaaaggcaugagcuacgugaugugcacuggcagcuuuaaacuugaaaaagaagucgcggaaacccaacacggcacuguccucguacaaauaaaauacgaaggaaccgacgcucccugcaaaaucccuuucagcacacaagacgaaaaaggagucacccaaaacggacgccucaucacugccaacccaaucguaacagacaaagaaaaacccguaaacaucgaagcagaaccacccuucggcgaauccuacaucguaaucggagcaggcgaaaaggcccucaaacucucgugguucaagaaaggcuccucgaucgggaaaauguucgaagccaccgccagaggagccagaagaauggccauacuaggcgauaccgccugggacuucggcuccaucggaggagucuucaccuccgucggcaaacuuguccaccagaucuucggcaccgcauacggcguacucuucuccggaguuagcuggaccaugaaaaucggaauaggcguccuccucaccuggcucggccuaaacuccaggagcacaagccuuuccaugacaugcaucgcgguaggacucgucacccucuaccuaggugucaugguacaagcguaa

SEQ ID NO: 2358 - RNA, 2043 nt, Artificial Sequence
  derived and/or modified CDS sequence (opt11) from DENV-1 CYD23__SSopt-prME(S186F)
augaaacggaaaaagucaguaaccaugcuccucaugcuaaugcccaccgcacucgccuuccaucucaccacacgcggaggcgaaccccacaugauuguuagcaaacaagaaagaggaaaaagccuacuauucaaaaccucagcaggcguaaacaugugcacacucaucgcuauggaccuaggcgaacucugcgaagacaccaugaccuacaaaugcccacgcaucacagaagcagaacccgacgacguugacugcuggugcaacgccacagacaccugggucaccuacggcacuugcagccaaaccggggaacaccgccgcgacaaacgauccguagcacuagcgccccauguaggucuaggccucgaaacacgaacagaaacguggaugagcuccgaaggagccuggaaacaaauacagcgcgucgagacaugggcacugagacacccaggcuucaccgugaucgcccucuuccucgcccacgccaucggcaccaguauuacccaaaaaggaaucaucuucauacuucucaugcuuguaacaccaucaauggccaugcgcugcguaggcaucggaucacgcgacuucguagaaggcuuaagcggcgcaacaugggucgacguaguccuagaacacggguccugcgucacaacaauggcaaaagacaaaccgacacuagacaucgaacuacugaagaccgaagucacaaaccccgccgugcuccgaaaacucugcauugaagcaaaaaucagcaacacaacaaccgacagccgaugcccaacgcagggcgaagccacccuagucgaagaacaagaugccaacuucguaugccgccgaacauucguagaccgaggcuggggcaacggcugcggacuguucgggaaggggagccucauaaccugcgccaaauucaaaugcgucaccaaacuggaagggaagaucguacaauacgaaaaccuaaaauacagcguaauuguaaccguccacacaggugaccaacaucaagugggcaacgaaagcaccgagcacggcacaaccgcgaccauuacaccacaagccccaaccaccgagauccaacuaacagauuacggagcgcuuacgcuagacugcuucccccggacaggacuggacuucaacgaaaugguccugcuaaccaugaaggaaaaguccuggcuuguccacaaacaaugguuccuugaccucccacugcccuggacauccggcgcaagcacuucacaagaaaccuggaauagacaagacuuacucguaacauucaagaccgcacacgccaagaaacaagaagucgucguacucggcagccaagaaggagcgaugcacaccgcccugaccggugcaaccgaaauccaaacaagcggaacuaccacgaucuucgccggacaccugaaaugccgccuaaaaauggacaaacugacacuaaaaggcaugagcuacgucaugugcacaggcuccuucaagcucgaaaaagaaguagcagagacccagcacgggaccguacucguccagaucaaauaugaagguacagacgcccccugcaaaauaccguucucaacgcaagaugaaaaaggaguuacccagaacggacgacugauaacagcaaauccaaucgucacagacaaagagaaaccagucaacaucgaggccgaacccccauucggagaguccuauaucguaaucggagcaggagaaaaagcccucaaacuauccugguucaagaaagguagcuccaucgggaaaauguucgaagccacagcccggggagcgcgacggauggcaauacucggcgacaccgccugggacuucggcuccauaggcggcguauucacuagcgugggcaagcucguccaccagaucuucggaacugccuacggaguccuauuuagcggaguaagcuggacaaugaaaaucggcaucggcgugcuccugaccuggcugggccugaacucccgauccacaucccugagcaugaccugcaucgcaguaggccucguaacccuguaucucggcgucauggugcaggccuaa

SEQ ID NO: 2359 - RNA, 2043 nt, Artificial Sequence
  derived and/or modified CDS sequence (opt11) from DENV-1 CYD23__SSopt-prME(R188L)
augaaacgaaagaaaagcgucacaaugcugcuaaugcuaaugcccacagcauuagccuuccaucucaccacacgagggggcgaaccccauaugauuguaagcaaacaggaacgcggaaaaagccuccuauucaaaacgagcgccggcguaaacaugugcacccucauugccauggaccuaggcgagcucugcgaagacacgaugacauacaaaugcccacgaaucaccgaagccgaaccagacgacgucgacuguuggugcaacgccacagacaccugggucaccuacggcacaugcucacaaacgggcgaacaccggcgcgacaaacgguccguggcccuggccccacacgucggucuaggacuagaaacgagaacagagaccuggaugagcagcgaaggggccuggaaacaaauccaacgcguggaaaccugggcgcuaagacaccccggcuucaccgucaucgcccucuuccuagcacacgccaucggaaccucaauaacccaaaaaggcaucauauucauccuacucaugcuggucaccccaagcauggccaugcgcugcguaggaaucgguaguagagacuucguggaaggccuuagcggcgcaaccugggucgacgucguccuggaacacgguucaugcguaaccacaauggccaaagacaaaccaacccucgacaucgaacuccuaaaaaccgaaguaacaaaccccgcaguccucagaaaacugugcauagaagcgaaaauuuccaacaccacaaccgauagccgaugccccacccaaggcgaagccacacuggucgaagaacaggacgcuaacuucguaugccgacgcacauucguugaccgcggcuggggcaacggcugcggacuauucgguaaaggcagccuuauaacaugcgccaaauuuaaaugcguaaccaaacucgagggcaaaauaguacaguacgaaaaucucaaauacuccgucauagucacgguacacaccggcgaccaacaucaagucggcaaugaaagcaccgagcacgggacaacggcaaccaucacaccgcaagcaccaacaacggaaauccaacucaccgacuacggcgcccugacacucgacugcagccccuuaacaggccuggacuucaacgaaaugguucuccuaacuaugaaagagaaaaguuggcuaguccacaaacaaugguuccuagaccuaccucuacccuggacaagcggcgccucaaccucccaggaaacauggaacagacaagaccuacuugugacauucaaaaccgcgcacgcaaagaaacaagaggucguaguacucggcucacaagaaggcgcgaugcacaccgcccugaccggugccacagagauacaaaccucaggcaccacaacaauauucgccggccaccugaaaugccgcuuaaaaauggacaaacucacucucaaaggaaugagcuacgucaugugcacaggcucauucaaacuagagaaagaagucgcagaaacccaacacggcaccguccuaguccaaauaaaauacgaaggaaccgacgcaccaugcaaaaucccauucuccacccaggacgaaaaaggcgucacccaaaacggacgccuuaucacagccaaucccaucgucaccgacaaagaaaagccaguaaacaucgaagcagaacccccauucggcgaaucauacaucgucaucggggcaggggaaaaggcccucaaacuuucaugguucaagaaaggauccagcaucggaaaaauguucgaagcgacagcccgaggcgcacgccggauggccauccucggagacacagcaugggacuucggcagcaucggcggagucuuuacauccgucggaaagcuaguacaccagaucuuuggcacagcauacggaguccuuuucucaggcguaagcuggacgaugaaaauaggcauaggcguacuauuaaccuggcuaggccucaacucaagguccacaagccuguccaugacauguauagcagugggccucgucacccucuaccucggcguaauggugcaagccuaa

SEQ ID NO: 2360 - RNA, 2043 nt, Artificial Sequence
  derived and/or modified CDS sequence (opt11) from DENV-1 CYD23__SSopt-pr(D104A)MEdelstem_TM,(F108S)-JEV
augaaaagaaagaaaucaguaacaauguuacucaugcucaugccaacggcccuggcguuccaccuaacaacgcgcggaggggaaccgcacaugauugucucgaaacaagaaagaggaaaaagccuccuguucaaaacgagcgcgggcgugaacaugugcacccucauagccauggaccugggcgaacucugcgaggacaccaugaccuacaaaugccccaggauaacggaagcagaaccagaugacgucgacugcuggugcaaugccaccgacacauggguaaccuacggaaccugcucacaaacgggcgaacacagacgcgccaaacggagcgucgcacuagcaccgcacgugggacuaggacuagaaacccgcacagaaacguggaugagcagcgaaggagccuggaaacagauacaacgcguagaaacaugggcacuacgacaccccggauuuaccguaauagcacuauuccucgcgcacgcaaucgguacauccauuacgcaaaaaggcauaaucuucauccugcuaaugcuaguaacaccauccauggccaugcggugcgucgggaucgguagucgagacuucgucgaaggccuaagcggagccacauggguagacgucguacuugaacacggaagcugcguaaccaccauggcaaaagacaaacccacccucgacauagaacuacuaaaaacagaagucacgaaccccgccguacuaagaaaauuauguaucgaagcgaagaucagcaacacaaccaccgacagcagauguccgacacaaggagaggccacgcucguagaagaacaggacgccaacuucguaugcaggagaacauucguggaccggggcuggggcaacggaugcggccuauccggaaaaggaagucugauaacgugcgcaaaauucaagugcguaacgaaacuagaaggaaaaauagugcaguacgagaaccuaaaguauagcguaaucguaacaguacacaccggagaccaacaucaaguugggaacgaaucuacugaacacgggacaacagccacaaucacaccccaagcgccaaccacggaaauucagcugaccgacuacggagcccucacacucgacugcagcccacgcacaggacucgacuucaacgaaauggugcuacucacaaugaaagagaaaucguggcuaguccacaaacagugguuccucgaccucccgcuaccauggacgagcggagcaucaacaagucaagaaacuuggaacaggcaagaccuccugguaaccuucaagacugcacacgcaaagaaacaagagguggugguacugggaucccaagagggagcgaugcacaccgcacugacaggcgcgaccgagauccagacaucgggaaccacgacgaucuucgcaggacacuugaaaugucggcuaaaaauggauaaacucacacucaaaggcaugagcuacgucaugugcacaggcagcuucaaacucgaaaaagaagucgcggaaacccaacacgguacaguccucguccaaaucaaauacgaagguaccgacgcgccuugcaaaauaccauucucaacacaagacgaaaaaggcgucacccaaaacggacgacugaucaccgccaaccccauaguaacggacaaagaaaaacccguaaacaucgaagccgaaccgcccuucggcgagagcuauauagucaucggagcuggagaaaaagcccugaaacugagcugguucaagaaagggagcacgcucgggaaagcauucucaacaacgcugaagggcgcacaacgacuagccgcccuaggagacacagcgugggacuucggcagcauaggaggaguauucaacucgaucggacgcgcgguucaccaaguguucggaggcgccuucagaaccuuauucggaggaaugucauggaucacccaaggacucaugggcgcacucuuacucuggaugggagucaacgcgagggacagaagcaucgcacuagccuuccuggcgacagggggaguacucguauuccuggccacaaacguacacgcguaa

SEQ ID NO: 2361 - RNA, 2043 nt, Artificial Sequence
  derived and/or modified CDS sequence (opt11) from DENV-1 CYD23__SSopt-prMEdelstem_TM,(H261N)-JEV
augaaacgcaaaaagucagucaccaugcugcuaaugcucaugcccaccgcacuagcguuucaccucacaaccagagguggagaaccacacaugauagucaguaaacaggaaagaggcaagagcuuacucuucaagaccuccgcaggcguaaacaugugcacucucauagcgauggaccucggcgaacucugcgaagacaccaugaccuacaaauguccccgaaucaccgaagcagaacccgaugaugucgacugcuggugcaacgcgacggacacaugggugacauacggcacgugcagccaaacaggcgaacacagacgcgacaaacgaagcguagcccuagccccacacguuggccuaggccuagaaacacgaacagaaacguggaugaguuccgaaggagccuggaaacaaauccaacgcguagaaaccugggcgcuaaggcacccaggcuucaccguaauagcacucuuccucgcacacgcaaucggcaccagcauaacacaaaaggggauaauauucauccuacucaugcuggucacgccaucaauggcaaugcgaugcguuggaauaggcagcagagacuucguagagggccuaagcggcgcaacaugggucgacguaguucucgaacacgggucaugcgugacaacaauggcgaaagacaagccaacccuggacauugaacugcucaagacagaagucaccaaccccgccguccuaagaaaacuaugcauagaagcgaagauaagcaacaccacaaccgacagccggugcccaacccaaggcgaggccacccuagucgaagaacaagacgccaacuucguaugccgacgaacauucguagaccgcggcugggguaacggcugcggccucuucggaaaaggaagucucaucacaugcgcaaaauucaagugcguaacaaaacucgagggaaagauaguacaauacgaaaaccucaaguacucagucauagucacaguccacacaggcgaccaacaccaagucggaaacgaaagcaccgaacacgggacaacggccacaaucacaccccaagccccaaccaccgaaauccaacugacagacuacggagcacucacccuggacuguagcccccgaaccggacuagacuucaacgaaaugguacuccucaccaugaaagaaaaauccuggcucguacacaaacaaugguuccucgaccugccccugccuuggaccagcggcgcgucaacgucacaagagaccuggaaccgccaagaccuccuaguaacguucaaaaccgcacacgcgaaaaagcaagaagucgugguccuaggcagccaagagggagcaaugaacacagcacuaacaggagcaaccgaaauccaaacaucaggaacaaccacaaucuuugccggccaccuaaagugcagacuaaaaauggacaaauugacacugaaaggaaugagcuacgucaugugcacaggaucauucaagcucgagaaagaagucgccgaaacacaacacgggaccgugcuaguacaaauaaaauacgagggaacagacgcgcccugcaaaaucccauucaguacgcaagacgagaaaggaguaacccaaaacgggcgacucaucacggcaaacccaauaguaaccgacaaagaaaaacccgugaacauagaagccgaacccccauucggggagagcuacaucguaaucggagccggagaaaaagcacuaaaacuaagcugguucaagaaaggauccacccuagggaaagcauucucgaccacacuaaaaggagcacaaagacuggcagcccuaggcgacaccgcaugggacuucggcagcaucgggggcgucuucaacagcaucggacgagccguacaccaaguauucggcggggcuuuccgcacccuguucgggggaaugaguuggauaacccaaggacuaaugggcgcccuacuccucuggaugggcguaaacgcaagagacagaagcauagcccuggcguuccuagccacaggcggggugcuaguauuccucgccacgaacguacacgcauga

SEQ ID NO: 2362 - RNA, 2043 nt, Artificial Sequence
  derived and/or modified CDS sequence (opt11) from DENV-1 CYD23__SSopt-prMEdelstem_TM,(R188L,A267T)-JEV
augaaacgcaagaaauccgucaccaugcuacuaaugcuaaugcccacggcccuggcauuccaccugaccacgcgcggcggcgagccucauaugaucguaagcaaacaagaacgaggcaaaagccuacucuucaaaacaagugccggagugaacaugugcacgcucauagcuauggaccucggcgaacuuugugaagacaccaugaccuacaaaugccccagaauaaccgaagccgaaccggacgacgucgacugcuggugcaacgcaacggacacauggguaaccuacggaaccugcucgcagacgggcgagcaccgccgcgacaaacgaucagucgcccucgccccgcacgugggacugggacuggaaacccgcacagagacguggaugaguucagaaggggcauggaaacaaauccaacgcguagaaaccugggcacucagacaccccggauucacagugaucgcacuuuuucucgcacacgccaucggaacaucaauaacacagaagggaauaaucuucauccuccucauguuagugaccccaucaauggccaugcgcugcguagggauagguagcagagacuucgucgagggacuaagcggagccacauggguagacgucguccuagaacacggcuccugcguaacaacaauggccaaggacaaaccaacccuagacauagaacugcuaaaaacagagguaacgaacccagcaguccuaagaaaacugugcauagaagcaaaaauaagcaacacgacuaccgauagccgcugcccgacgcaaggcgaagccacacuggucgaggagcaagacgcaaacuucguaugccgacgcacguucguggaccggggcuggggaaauggaugcggccuauucggaaaagggagccuaaucacgugcgcgaaauucaaaugcgucacgaaacuggaagggaaaaucguccaauacgaaaaccugaaauacagcgucaucgugaccguacacacaggagaccaacaccaagugggcaacgaaagcaccgaacacggcacaacugccacgauaacaccccaagcacccaccacagaaauccaacuaacugauuacggcgccuuaacccucgacuguucaccacucacgggccuagacuucaacgaaauggugcuauuaacuaugaaagagaaaucauggcugguccacaaacaaugguuccuagaccucccacuccccuggaccagcggagcaucaacuucacaagagaccuggaaccggcaagaucuccucgucaccuucaaaaccgcacacgccaaaaagcaagaggucguggugcuaggcagucaagagggagcaaugcacaccgcgcuaacaggcacgacagaaauccaaacaucaggaacgacaacaauauucgccggacaccuaaaaugccgccuuaaaauggacaagcucacccuaaagggaaugagcuacgucauguguacaggaucguucaagcuggaaaaagaaguagcagagacacaacauggaacaguacucguccaaaucaaauacgaggguacggacgcaccaugcaagauacccuuuagcacacaagacgaaaaaggcgucacccaaaacgggcgacucauaacggcaaauccaauaguuacagacaaagaaaagcccguaaacauagaagcggaaccacccuucggcgaaagcuauaucgucaucggagccggggaaaaagcacuaaaacugagcugguucaagaaaggaagcacgcuaggcaaagcguucucaaccacacucaaaggagcacaaagacucgccgcacuaggcgacaccgcaugggacuucggaagcaucggcggcgucuucaacucaaucggacgcgcgguucaccaagucuucgggggcgcauuccgaacccuguucggcggcaugagcuggaucacccaaggacuaaugggagcacuccuacucuggaugggagucaaugcacgagacaggagcauagcacuggccuuccuagcaacagggggagugcuaguguuccuagcgacgaacguccacgcauaa

SEQ ID NO: 2363 - RNA, 300 nt, Artificial Sequence
  derived and/or modified CDS sequence (opt11) from DENV-2 CYD2-T__C
augaacaaccaacgcaaaaaagccaaaaacacccccuucaacaugcucaaacgcgaacgcaaccgcgucuccaccguccaacaacucaccaaacgcuucucccucggcaugcuccaaggccgcggcccccucaaacucuucauggcccucgucgccuuccuccgcuuccucaccaucccccccaccgccggcauccucaaacgcuggggcaccaucaaaaaauccaaagccaucaacguccuccgcggcuuccgcaaagaaaucggccgcaugcucaacauccuaaaccgccgccgccgc

SEQ ID NO: 2364 - RNA, 342 nt, Artificial Sequence
  derived and/or modified CDS sequence (opt11) from DENV-2 CYD2-T__C-SSc
augaacaaccaacgcaaaaaagccaaaaacacccccuucaacaugcuaaaacgcgaacgcaaccgcgucucaaccguccaacaacucaccaaacgcuucucccucggcaugcuccaaggccgcggcccccucaaacucuucauggcccucgucgccuuccuccgcuuccucaccaucccccccaccgccggcauccucaaacgcuggggcaccaucaaaaaauccaaagccaucaacguccuccgcggcuuccgcaaagaaaucggccgcaugcucaacauccucaaccgccgccgccgcuccgccggcaugaucaucaugcucauccccaccgucauggcc

SEQ ID NO: 2365 - RNA, 273 nt, Artificial Sequence
  derived and/or modified CDS sequence (opt11) from DENV-2 CYD2-T__pr
uuccaccuaaccaccagaaacggcgaaccccacaugauagucucccgccaagaaaaaggcaaaagccuacucuucaaaacagaagacggcgucaacaugugcacacucauggccauggaccucggcgaacucugcgaagacaccauaaccuacaaaugcccccuacucagacaaaacgaaccagaagacaucgacugcuggugcaacagcaccagcaccugggucaccuacggcacaugcaccaccaugggcgaacacagacgcgaaaaacgc

SEQ ID NO: 2366 - RNA, 225 nt, Artificial Sequence
  derived and/or modified CDS sequence (opt11) from DENV-2 CYD2-T__M
uccgucgcccucgucccccacgucggcaugggccucgaaacccgcaccgaaaccuggauguccuccgaaggcgccuggaaacacguccaacgcaucgaaaccuggauccuccgccaccccggcuucaccaugauggccgccauccucgccuacaccaucggcaccacccacuuccaacgcgcccucaucuucauccuccucaccgccgucacccccuccaugacc

SEQ ID NO: 2367 - RNA, 498 nt, Artificial Sequence
  derived and/or modified CDS sequence (opt11) from DENV-2 CYD2-T__prM
uuccaccucaccacccgcaacggcgaaccccacaugaucguaucccgccaagaaaaaggcaaaucccuccucuucaaaaccgaagacggcgucaacaugugcacccucauggccauggaccucggcgaacucugcgaagacaccaucaccuacaaaugcccccuccuccgccaaaacgaacccgaagacaucgacugcuggugcaacuccaccuccaccugggucaccuacggcacaugcaccaccaugggcgaacaccgccgcgaaaaacgcuccgucgcacucgucccccacgucggcaugggccucgaaacccgcaccgaaaccuggaugucauccgaaggcgccuggaaacacguccaacgcaucgaaaccuggauccuccgccaccccggcuucaccaugauggccgccauccucgccuacaccaucggcacaacccacuuccaacgcgcccucaucuucauccuacucaccgccguaaccccauccaugacc

SEQ ID NO: 2368 - RNA, 1485 nt, Artificial Sequence
  derived and/or modified CDS sequence (opt11) from DENV-2 CYD2-T__E
augagaugcauagggaugucgaacagagacuucguagaagggguaagcggagggucguggguggacauaguccuggaacacggaagcugcgugacaacaauggcgaaaaauaagccgacacuagacuucgaguugaucaagacagaggccaagcagccagcaacgcugagaaaauacugcauagaagcaaaacugaccaacacaacgacagagagcagaugcccgacacagggagaacccucacuaaacgaggagcaagacaaacgcuucguaugcaaacacagcaugguggacagaggcugggggaacggcugcggccuauucgggaagggaggcauaguaacgugcgcaauguuccgcugcaagaaaaacauggaaggaaaagucguacagccggaaaaccucgaauacacaauaguaaucacaccacauucaggcgaggagcacgccguggggaacgacacggggaaacacgggaaagagaucaagauaacaccccagagcaguauaacggaagcggaacuaaccggauacggaaccgugaccauggaaugcaguccgcgaacggggcuggacuucaacgagauggugcuccugcaaauggagaacaaagcguggcugguacaccggcagugguuccucgaccuaccgcucccauggcuacccggggccgacacacaagggucgaacuggauacagaaagaaacacuggucacauucaaaaacccgcacgcgaaaaagcaagacguaguaguacuaggaagccaagagggagcgaugcacaccgcacuaacaggagcgacggagauccagaugagcagcgggaaccugcuauucaccgggcaccugaagugccgccugcgcauggacaagcuccagcucaaagggaugagcuacagcaugugcacaggcaaguucaaggucgugaaggagaucgcggaaacccaacacggcacgaucgugaucagggugcaauacgaaggcgacggcucgccaugcaaaauacccuucgaaauaauggaucucgagaaacggcacgugcucggaagacugauaacggucaaccccauagucacagaaaaggacucacccguaaacaucgaagcggaaccgccauucggcgauagcuacaucauaauagggguagaaccaggacaacugaaacuaaacugguucaagaaagggagcagcauaggacaaauguucgaaaccacgaugaggggagcgaagagaauggcaaucuugggagacaccgcaugggacuucggaagccucggagggguguucacaucaauagggaaagcgcuacaccaaguguucggggccauauacggggccgcguucucgggagugagcuggacaaugaagauccucaucggagugaucauaacauggaucgggaugaacagcagaucgacgagcuugagcgugacacuggucuugguagggaucgugacauuguacuugggcgugauggugcaagcc

SEQ ID NO: 2369 - RNA, 1983 nt, Artificial Sequence
  derived and/or modified CDS sequence (opt11) from DENV-2 CYD2-T__prME
uuccaccuaacaacacgaaacggcgaaccccauaugauagugucacgccaagaaaaggggaaaagucuacucuuuaaaaccgaagacggagucaacaugugcacacuuauggccauggaccuaggagaacuaugcgaagacacaaucacauauaaaugcccccuccugagacaaaacgaaccagaagacaucgacugcuggugcaacaguaccagcacgugggucacuuacggcacaugcacuacaaugggagaacaccgccgagagaaaagguccgucgcccucgucccacacgucggaauggggcucgaaacccgaaccgaaaccuggauguccucagaaggcgccuggaaacacguccagcgaauagaaacauggauccuacgccauccaggguucaccaugauggcggccauacuagcauacacaauuggcacgacacacuuccaaagagcccucauauucauccuacucaccgccgucaccccaagcaugacaaugcgcuguaucggaaugucgaaccgagacuucgucgaagggguaagcgggggaucauggguagacauaguacuggaacacggaucaugcguaacaacgauggccaaaaacaagcccacacucgauuuugaacucaucaaaaccgaagccaagcaacccgccacacuccgcaaauacugcauagaagccaaacugaccaacaccaccaccgaaagcagaugccccacccaaggagaaccaagccucaacgaggaacaagacaaaagauucguaugcaaacacucaaugguagaucgcggaugggggaacggcugcggccucuucggaaaaggaggaauaguaaccugcgcgauguuccgaugcaaaaagaacauggaaggcaaagucguccaacccgaaaaccuagaauacaccaucgucauaaccccacacagcggagaggaacaugcggucggcaacgacacagggaaacacggaaaagagauaaaaauaacaccacaaucaagcaucacagaagcagaacuaacaggcuacggcaccguaacaauggaaugcuccccacgcacaggacucgacuuuaacgagaugguacuccugcaaauggaaaacaaggcuuggcucguccaccgccagugguuccuagaccugccacucccauggcuacccggcgccgacacccaaggcucgaacuggauccaaaaagagacccucguaaccuucaaaaacccgcacgccaagaaacaagacgucguaguccucggcucccaagaaggcgcaaugcacaccgcacucacaggcgccacagaaauccaaauguccucaggaaaccuccuauucacuggccaccucaaaugccgccuccgcauggacaaacuacaacucaaaggcaugagcuacucaaugugcacagggaaauucaaaguaguaaaagagauagccgagacucagcacggcacaauagugauccgggugcaauacgagggggacggcagccccugcaaaaucccauuugaaauaauggaccuagagaaacgccacguacucggccgccuaaucaccgucaaccccaucgucaccgaaaaagauagcccagugaacauagaagcagagcccccguucggcgacagcuacaucauaaucggcguagaacccggacaacucaagcucaacugguucaagaaaggcucaucaaucggccaaauguucgaaacuaccaugagaggagccaagcgcauggcaauccuaggcgacaccgccugggauuucggaucccuaggaggcguauucacaucaaucggaaaagcacuccaccaagucuucggcgccaucuacggcgcagccuucagcggcgucagcuggaccaugaaaauccuuaucggcgugauaauaacauggaucggcaugaacagucgcaguacaagucuaagcguaacccucguacucguaggcaucgucacccuguaucuaggcgucaugguccaagcc

SEQ ID NO: 2370 - RNA, 2025 nt, Artificial Sequence
  derived and/or modified CDS sequence (opt11) from DENV-2 CYD2-T__SSc-prME
agcgccggaaugaucauaaugcugauaccgaccguuauggccuuccaccuaacuacacggaacggcgaaccccacaugaucguguccaggcaagaaaaaggcaaaagccuacucuucaaaacagaagacggagucaacaugugcacccucauggccauggaccuaggagaacuaugcgaagacacaaucacauacaaaugcccacuacuccgacaaaacgaacccgaagacauagacugcuggugcaacagcacgucaaccugggucaccuacggaaccugcacaaccaugggcgaacaccgccgagaaaaacgcagcguagcacucgugccacacguaggcaugggacuagagacccgcacggaaacauggaugagcucagaaggcgccuggaaacacgugcaaaggauagaaaccuggauacuacgccaccccggguucaccaugauggccgcgauccuggcauauaccauagguaccacacacuuccaacgagcccucauauucauacuacuaacagccguaacgcccuccaugacgaugcgcugcaucggcaugagcaacagagacuucgucgaaggcguaagcggaggaaguugggucgacaucguccucgaacacggcagcugcgucaccaccauggccaaaaacaaaccgacacuagacuucgaacucaucaaaaccgaagcaaaacaaccggccacccucagaaaauacugcauugaagccaagcuaacgaacacaacuacagaaagcagaugcccaacccagggagaaccaucacucaacgaggaacaggacaaacgauucgucugcaaacacagcauggucgacagaggcuggggaaacgggugcggccuauucggcaaaggaggaauagucacgugcgccauguuccggugcaagaaaaacauggaaggcaaaguaguccaaccggaaaaccuggaauacacgauagucaucacaccccacucuggcgaagaacacgccgucggcaacgacacggggaaacacggaaaagaaauuaaaaucacaccccagucgagcaucaccgaagcggaacugacuggcuacgggaccgucacaauggaaugcuccccacgaaccggccuagacuucaacgagaugguccuccugcaaauggagaacaaagcauggcucguccaccgacagugguuccucgaccuuccacucccguggcuccccggcgcggacacacaaggcucaaauuggauccaaaaagaaacccuagucaccuucaaaaacccacacgccaagaaacaggacgucguaguccuagguucacaagaaggggccaugcacaccgcccugaccggagccacagaaauacaaauguccuccggaaaccuccuauucaccgggcaccugaaaugccgguuacgaauggacaaacuacaacuaaagggaaugucauacuccaugugcacaggaaaauucaaagucgucaaagaaaucgccgagacccaacacggaacuauagucauccggguccaauacgagggagacggaagcccgugcaagauccccuucgaaauaauggaccucgaaaaacgccacguacuaggacgacuaauaaccgucaauccaaucguaacagagaaggacagucccgucaacaucgaagcagagccaccauucggagacagcuacaucaucaucggaguagaaccgggccaacugaaacuuaacugguucaagaaaggcagcagcauaggccaaauguucgagacaacgaugcgaggcgcgaaacgaauggccauccucggcgacacagccugggauuucggaucacuaggcggcguuuucacgagcauaggcaaggcccuacaccaaguauucggcgccauauacggggcggccuucagcggggugaguuggaccaugaaaauccuaauaggcgucaucauaaccuggauaggcaugaacucccgcuccacaagccuaagcgugacccuaguacucguagguaucguaacacucuaccucggcgugaugguacaagcc

SEQ ID NO: 2371 - RNA, 2325 nt, Artificial Sequence
  derived and/or modified CDS sequence (opt11) from DENV-2 CYD2-T__C-prME
augaacaaccaaagaaagaaagccaaaaacaccccauucaacaugcuaaagcgcgagcggaaccgcguaagcacaguacaacaacuaaccaaacgcuucucacuaggcaugcuacaaggacgcggcccccuaaaacuauucauggcgcucguagcguuccugagauuccucacaauaccacccacagccggcauacucaaacgauggggaaccaucaagaaaucaaaagccaucaacgugcuacgaggcuucaggaaagagaucggacgcaugcuaaauauacucaaccggcgaagacgcuccgcaggcaugauaaucaugcucauccccaccguaauggcguuccaccugaccacacgaaacggagaaccccacaugaucgucucaagacaggaaaaaggaaaaagccuccuguucaaaacagaagacgggguaaacaugugcacgcucauggccauggaccuuggcgagcuaugcgaggacaccaucaccuacaaaugcccacugcuccgccagaacgaaccagaagacauagacugcuggugcaacagcacaagcacguggguaaccuacgggacgugcacaaccaugggagagcaccgccgcgagaaacgaagcguggcccuagucccgcacgugggcaugggacucgaaacacgaaccgagacauggauguccuccgaaggagccuggaaacacguccaacgcauagaaacguggauacugaggcacccaggcuucaccaugauggcagccauacucgcauacacaaucggcaccacacacuuccaaagagcccugaucuucaucuuacuaacagcugugaccccaagcaugaccaugagaugcauaggcaugucgaacagggacuucgucgaaggcguauccggcggcucguggguggacaucguccuggaacacggcuccugcgucacgacaauggcgaaaaacaagcccacccucgacuuugaacugaucaaaaccgaagcaaagcaaccagcuacacucagaaaauacugcauagaagcgaaacuaaccaacacgacgacagaaagcagaugcccgacccaaggcgaacccucacucaacgaggaacaagauaaacgauucgucugcaaacacagcauggucgacagaggauggggaaacggcugcggccucuucggcaaaggaggaauaguaacgugcgcaauguuccgaugcaagaaaaacauggagggaaaaguaguccaaccggaaaaccucgaauacacaaucguuauaacaccgcacuccggcgaggagcacgcaguggggaacgacacaggaaaacacggaaaagaaauaaaaaucacaccccaaagcuccaucacagaagccgaacuaaccggcuacggaaccguaacaauggaaugcagcccccgaacagggcuagacuucaacgaaauggugcuauugcaaauggaaaacaaagcauggcucguccaccgccaaugguuccucgaccuaccgcuacccuggcuaccaggcgccgacacgcaaggaucaaacuggauacagaaagaaacccucguaaccuucaaaaacccacacgcaaagaaacaagacguagugguacucggaagccaagaaggcgcgaugcacaccgcucucacuggcgccacagaaauccagaugucgucgggaaaccuccuguucacaggccaccuaaaaugccgccuacgcauggauaaacuacaacucaaaggcaugagcuacaguaugugcaccggcaaguucaagguggucaaagaaaucgcggaaacccaacacggcacaauaguuaucagaguccaauacgaaggcgacggcucacccugcaaaauaccauucgagauaauggaccucgagaaacgccacguucuaggccgccuaaucacaguaaaccccaucgucacggaaaaagacucacccgucaacaucgaagccgagccgcccuucggagauagcuacauaaucaucggcguugaaccaggacaacuaaaacugaacugguucaagaaaggcagcuccauaggccaaauguucgagacaacgaugcgaggcgcaaaacgcauggccauucucggcgacaccgccugggacuucggcucccugggcggaguguucacguccaucggcaaagcccuccaucaaguauucggagcaauauacggcgcugccuucucaggggucagcuggaccaugaaaauucucauaggcgucauaauaaccuggauaggaaugaacuccagaagcacaucccuaucaguaacccuaguccuaguaggaaucgucacccucuaccuuggagucaugguacaagca

SEQ ID NO: 2372 - RNA, 45 nt, Artificial Sequence
  derived and/or modified CDS sequence (opt11) from DENV-2 CYD2-T__SSc
augagcgcgggcaugaucauaauguugaucccgaccgugauggcg

SEQ ID NO: 2373 - RNA, 57 nt, Artificial Sequence
  derived and/or modified CDS sequence (opt11) from DENV-2 CYD2-T__SSopt
augaaaaggaaaaagagcgcgggcaugaucauaauguugaucccgaccgugauggcg

SEQ ID NO: 2374 - RNA, 57 nt, Artificial Sequence
  derived and/or modified CDS sequence (opt11) from DENV-2 CYD2-T__SSm
auguuccaacgcgcccucaucuucauccuccucaccgccgucacccccuccaugacc

SEQ ID NO: 2375 - RNA, 1488 nt, Artificial Sequence
  derived and/or modified CDS sequence (opt11) from DENV-2 CYD2-T__E
augcgcugcaucggaaugucgaaccgcgacuuugucgaaggcgucagcggaggcuccugggucgacauaguccucgaacacggcucuugcguaaccaccauggccaaaaacaaaccgacccuagacuucgaacucaucaaaacagaggcaaaacaacccgccacccuccggaaauacugcauagaagcaaaacuaaccaacacaacuaccgaaagucgcugcccgacccaaggcgaaccaucgcuaaacgaagaacaagacaaacgguucguaugcaaacacagcauggucgaccgcggcuggggcaacggcugcggccuauucggaaaaggcggcauaguaaccugcgcgauguuccgcugcaaaaagaacauggagggcaaagucguccaaccagaaaaccuagaauacaccaucgucauaacaccccacuccggcgaagaacacgccgugggcaacgacaccggcaaacacggcaaagagauaaaaaucacaccacaauccucaauaacagaagcagaacucacgggauacggcacagucacaauggagugcagcccacgcaccggccuggacuucaacgaaaugguccuacuccaaauggaaaacaaagcauggcucguacaccgacaaugguuccucgaccucccacucccauggcugcccggagccgacacacaaggauccaacuggauccaaaaagaaacccuagucacauucaaaaacccccacgcgaagaaacaagauguagucguccucggcagccaagagggcgcaaugcacaccgcacucaccggcgcaaccgagauccaaaugagcagcgggaaccuacuauucaccggacaccucaaaugccgcuuacgaauggacaaacugcaacuaaaaggcaugagcuacuccaugugcacaggaaaauucaaagucguaaaagaaaucgccgaaacacagcacggaaccaucguaaucagaguccaauacgaaggagacggcucacccugcaaaauacccuucgaaauaauggaccucgaaaaacgacacguccuaggacgucucaucaccgucaacccaauagucaccgaaaaagacucaccagucaacaucgaagccgaacccccauucggcgacagcuacaucaucauaggcguagaaccaggacaacucaaacuaaacugguucaagaaaggaucuagcaucggccaaauguucgaaaccaccaugcgcggagccaaacggauggccauccucggagacacagcaugggauuucggcagucucggcggaguauucacauccaucggcaaagcccuccaccaaguauucggcgcgauauacggcgccgcauucuccggcguaagcuggaccaugaaaauccuaaucggcgucaucauaacauggaucggcaugaacucccgaagcacgagccucagcguaacccuagucuuagucggcaucgucacacuguaccuaggcguaaugguccaagcauaa

SEQ ID NO: 2376 - RNA, 1182 nt, Artificial Sequence
  derived and/or modified CDS sequence (opt11) from DENV-2 CYD2-T__EdelTM-variant (aa1-394)
augagaugcauaggcaugucaaacagagacuucguggaaggcguauccggaggaagcuggguggacaucguacuagaacacggcagcugcguaaccaccauggccaaaaacaaacccacccucgacuucgaacuaauaaaaacagaagcaaaacaaccagccacccuacgcaaauacugcaucgaagccaaacucaccaacacaacgacagaaagccgcugccccacacaaggcgaacccagccucaacgaagaacaagacaagcgauucgucugcaaacacucaauggucgaccgcggcuggggcaacggcugcggacucuucggcaaaggcggcaucguaacaugcgccauguuccgcugcaagaaaaacauggaaggcaaaguaguacaacccgaaaaccucgaauacaccauagucaucaccccacacaguggagaagaacacgcagucggcaacgacacaggcaaacacggcaaagaaaucaaaaucacaccccaguccucaauaaccgaagcggaacuaaccggcuacggcaccguaaccauggaaugcucaccccgcaccggacuagacuucaacgagaugguacuccuacaaauggaaaacaaagccuggcucguccaccgacaaugguuccucgaccuaccccuccccuggcuccccggcgcggacacacaaggcuccaacuggauccaaaaagaaacacucgucaccuucaaaaacccccacgccaagaaacaagacguagucguccugggaagccaagaaggagccaugcacacggcccugacaggagcgaccgaaauccagaugagcuccggaaaccuccucuucaccggccaccucaaaugccgccuccgaauggacaaacuacaacuaaaaggaaugagcuacagcaugugcacaggcaaauucaaaguaguaaaagaaauagccgaaacccaacacggcaccaucgucauccgcguacaauacgaaggcgacggcagcccaugcaaaaucccauucgaaaucauggaccuagagaaacgacacguccuaggacgccucauaaccgucaacccaauagucaccgaaaaagacagccccgucaacaucgaagcagaaccacccuucggcgacagcuacauaaucauaggcgucgaacccggccaacucaaacuaaacugguucaaaaag

SEQ ID NO: 2377 - RNA, 1272 nt, Artificial Sequence
  derived and/or modified CDS sequence (opt11) from DENV-2 CYD2-T__EdelTM-variant (aa1-424)
augcgcugcaucggaaugagcaaccgcgacuucgucgaaggagucagcggcggauccugggucgacauaguccucgaacacggcuccugcguaaccacuauggccaaaaacaaacccacccucgacuucgagcuaauaaaaacagaagccaagcagcccgcaacccuacgcaaguacugcauagaagccaaacucacgaacaccaccacagaaagccgaugccccacacaaggcgaacccagccucaacgaagaacaggacaaaagauucgucugcaaacacagcauggucgaccgaggauggggcaacggcugcggccuguucggaaaaggcggaaucguaacaugcgccauguuccgaugcaaaaagaacauggaaggcaaggucguccaaccagaaaaccuagaauacaccaucguaaucacaccacacagcggagaagaacacgcagucggcaacgacaccggcaaacacggcaaagaaaucaaaaucaccccacaaagcucaaucacagaagcugaacuaaccggcuacggaacaguaaccauggaaugcagcccccgaaccgggcuagacuucaacgaaaugguccuccuacaaauggaaaacaaagcauggcuaguccaccgacaaugguuccucgacuuaccccuacccuggcuaccaggcgccgacacccaaggcucaaacuggauccaaaaagaaacacucguaacauucaaaaacccccacgccaagaaacaagacgucguagucuuaggaagccaagaaggcgccaugcacacagcccuaacaggcgcaaccgaaauacaaaugucaagcggcaaccuccucuucacaggccaccucaaaugcagacuccggauggacaagcugcagcugaaaggcaugucauacucaaugugcaccggaaaauucaagguaguaaaagagaucgcagaaacccaacacggaaccaucgucauccgcguacaauacgaaggcgacggcucccccugcaaaauacccuucgaaauaauggaccuagaaaaacgucacguccucggccgacuaaucaccgucaaccccaucgucacagaaaaagacucaccaguaaacauagaagccgaaccacccuucggagacucauacauaauaauaggagucgagcccggacaacucaaacuaaacugguucaagaaaggaagcagcaucggccagauguucgaaaccaccaugcgaggagcaaaacgcauggcgauccuaggcgacaccgccugggacuucggcucc

SEQ ID NO: 2378 - RNA, 1263 nt, Artificial Sequence
  derived and/or modified CDS sequence (opt11) from DENV-2 CYD2-T__EdelTM-variant (aa1-421)
augcgcugcauaggcaugagcaacagagacuucgucgaaggagucagcggaggcagcuggguagacaucguacuagaacacggaagcugcguaacaaccauggccaaaaacaaacccacccuugacuucgaacucauaaaaacagaagcaaaacagcccgcgacccuacgaaaauacugcauagaggccaaacucaccaacaccaccacggaaagccgcugcccaacacagggcgaaccaagccucaacgaggaacaagauaaacgcuucgucugcaaacacagcauggucgaccgcggauggggcaauggaugcggccucuucgggaagggcgggauaguaaccugcgccauguucagaugcaagaaaaacauggaaggcaaagucguccaaccagaaaaccucgaauacacaaucguaaucacaccccacagcggggaagaacacgcaguaggaaacgacaccggcaaacacgggaaagaaauaaaaauaaccccacaaagcucaauaaccgaagccgaacuaaccggauacggcaccgucacaauggaaugcucaccccgaaccggacuagacuucaaugaaaugguacuccuacaaauggaaaacaaagccuggcucgugcaccgacaaugguuccucgaccuaccgcucccauggcuacccggagcggacacccaaggaagcaacuggauccaaaaagaaacccuaguaaccuucaaaaacccccacgccaagaaacaagacgucgucguacucggaagccaggaaggagcaaugcacaccgcguuaacaggagccacagagauccaaaugagcagcggaaaccuacuauucacaggccaccucaagugcagacuacgcauggacaaauuacaacuaaaaggcaugagcuacagcaugugcaccggaaaauucaaaguagucaaggaaaucgccgaaacacaacacggaaccauagucauacgcguccaauacgaaggcgacggcucaccaugcaaaauccccuucgaaaucauggaccucgaaaagcgacacguacucggccgacuaauaaccguaaacccaaucgugacagaaaaagacagcccagucaacaucgaagcagaaccacccuucggcgacucauacaucaucauaggcgucgaacccgggcaacucaaacuaaacugguuuaagaaaggauccagcaucggacaaauguucgaaacaaccaugagaggggcgaaacgcauggccauccuaggcgacaccgccugggac

SEQ ID NO: 2379 - RNA, 2031 nt, Artificial Sequence
  derived and/or modified CDS sequence (opt11) from DENV-2 CYD2-T__SSc-prME
auguccgcuggcaugauaauaaugcucauacccacagucauggcauuccaccuaacaacgcgaaacggagaaccccacaugaucgucagucgccaagaaaaaggaaaaagccuccucuucaaaaccgaagacggcgucaacaugugcacucucauggccauggaccuaggugaacucugcgaagacacgauaacauacaaaugcccacugcuacgacaaaaugaacccgaagacaucgacugcuggugcaacagcacaucaaccugggucacauacggaacaugcacaacaaugggagaacaccgacgcgaaaagcgcuccgucgcccuaguaccacacgucggaaugggccuagaaacucgcacagaaacauggaugagcuccgaaggcgccuggaaacacguccagaggauagaaacguggauacuccgccaccccggcuucaccaugauggccgcaauccucgcauacaccauuggaaccacccacuuccaacgcgcccuaaucuucauacuccuaacagccguaacacccagcaugacaaugagaugcaucggaauguccaaccgcgacuucgucgagggcguauccgggggaucaugggucgacaucguccuagagcacggcuccugcgucacuaccauggccaaaaacaaaccuacccuagacuucgaacucauaaaaacagaagcaaaacaacccgccacccuacgcaaauacuguaucgaagcaaaacucaccaacacgacuacugaaucaagaugccccacacagggagaacccagccuuaacgaggagcaagacaaacguuucguaugcaaacacagcaugguggacagaggcuggggcaacggcugcggccucuucggaaagggaggcauaguaacaugcgcuauguuccgaugcaaaaagaacauggaaggcaaagugguacaacccgaaaaccuagaauauacaaucgucauaacaccccacucaggcgaagaacacgcgguaggaaacgacaccggcaaacacggcaaggaaaucaaaauuacaccccagaguuccaucaccgaggcggaacugacaggcuacggcacagucaccauggaaugcagcccacgcacaggccuagacuucaacgaaaugguccuccuccaaauggaaaacaaagcauggcucguccaccgacagugguuccucgaccuaccccuaccauggcuccccggagcagacacccaggggagcaacuggauucaaaaagaaacgcugguaaccuucaagaacccucacgccaaaaagcaagacgucgucguacucggcagccaagaaggcgcaaugcacaccgcacucaccggagccaccgaaauccaaaugucgucagggaaccuucucuucacaggccaccucaagugccgccuccgaauggauaaacuacaacugaaaggcauguccuacagcaugugcaccggaaaauucaaagucgucaaagaaaucgcagagacacaacacggaaccaucguaauacggguccaauacgaaggggacggcucacccugcaagauccccuucgagauaauggaccucgagaaaagacacguacucggccgccucaucaccgucaacccaaucgucaccgaaaaggacagccccgucaacaucgaggcagaaccacccuucggagacagcuacauaauaauaggagucgaaccgggccaacucaagcucaacugguuuaagaaagggagcagcaucggucaaauguucgaaaccacaaugagaggcgcaaaacggauggcaauccuaggagacacagcaugggacuucggaagccuaggcggagucuucacgagcaucggcaaagcgcuacaccaaguauucggcgccauauacggcgccgccuucagcggcgucagcuggacaaugaaaauccuaaucggcgucauaauaacauggauaggcaugaacucccgcagcaccucacucagcguaacacucguccuaguaggaaucguaacacuauaccuaggagugaugguacaagcauaa

SEQ ID NO: 2380 - RNA, 2031 nt, Artificial Sequence
  derived and/or modified CDS sequence (opt11) from DENV-2 CYD2-T__SSc-prME(F108S)
augucggccggaaugaucaucaugcuuauccccaccgucauggccuuccaccucacaacacguaacggggagccacacaugaucgucucgagacaggaaaaaggcaagucacuacucuucaagacagaggacggcguaaacaugugcacccucauggcgauggaccucggcgaacucugcgaagacaccauaacauacaaaugcccccuacuacgccaaaacgaaccagaagacaucgacugcuggugcaacagcacaucaaccuggguaacguacggaacgugcacgaccaugggcgaacaccgacgagagaaaagaagcgucgcccucgucccccacgugggcaugggacuggaaacucgaacagaaacguggauguccuccgaaggcgcauggaaacacguccaacgcaucgaaaccuggauccuacgccaccccggauucacaaugauggccgcaauacuggcauacacgaucggaacaacucacuuccagcgcgcacucauauucauucuccucacagccguaacccccagcaugaccaugcgaugcaucgggaugagcaaccgagacuucguagaaggcguaagcggaggcagcuggguggacaucguccucgaacacggcucgugcguuaccacaauggccaaaaauaagccaacccuagauuucgaacucaucaaaaccgaagcaaaacaaccagcaacacuaaggaaguacugcaucgaagcaaaacuuaccaacaccaccaccgaaagcagaugcccaacccaaggcgaaccaucccucaacgaggaacaagacaagagauucguaugcaaacacuccauggucgaccgcggcuggggcaacggcugcggacucucaggcaaagggggcauaguaacaugcgccauguuccgcugcaagaaaaauauggaaggcaaagucguccaacccgagaaccucgaauacacaaucgucaucacaccccacucaggcgaggaacacgccgucggcaacgacaccggcaaacacgguaaagaaauaaaaaucacaccacaaagcagcauuacagaagcagaacuaacaggauacggaacgguaacaauggaaugcuccccacgaacaggacucgacuucaacgaaaugguacuccuacaaauggaaaauaaagccuggcucguccacagacaaugguuccuugacuuaccccuucccuggcugcccggggccgacacccaaggcucaaacuggauccaaaaagagacccuuguaaccuucaaaaacccccacgcgaagaaacaagacguaguaguccuuggcucacaggaaggagcaaugcacacagcccucacaggagcaacugaaauccaaaugucaagcggaaaccuccucuucaccggacaccugaaaugcagacucagaauggacaaacuccaacucaagggcauguccuacucgaugugcaccggcaaguuuaaagucguaaaagaaauagccgaaacacaacacggcacaauagucauacggguccaguacgaaggcgacggcucccccugcaagaucccauucgaaauaauggaccucgaaaaacgccacgugcucgggcgccucaucacagugaauccaaucgucacagaaaaagacucacccgucaacaucgaggcagaaccgcccuucggagacuccuacauaauaaucggcgucgaacccggccaacucaaacucaacugguucaagaaagguucaagcaucgggcaaauguucgaaacgacaaugcggggcgccaaaagaauggcaauacuaggcgacaccgccugggacuucgggagccugggcgggguguucaccuccaucggcaaagcgcuccaccaagucuucggagcaaucuacggcgccgcauucucaggcgucucauggaccaugaaaauccuaauaggcgucaucauaaccuggaucggaaugaacagcagaagcacaucccucucaguaacacuuguccuuguaggaaucgucacccuauacuuaggagucaugguccaagccuaa

SEQ ID NO: 2381 - RNA, 2031 nt, Artificial Sequence
  derived and/or modified CDS sequence (opt11) from DENV-2 CYD2-T__SSc-prMEdelstem_TM-JEV
auguccgcaggcaugauaaucaugcucauccccaccgucauggcauuccaccuaacaacccgcaacggcgaaccccacaugauaguuagccgccaagaaaaagguaaaagccuacuuuuuaaaaccgaagacggggucaacaugugcacacuaauggcaauggaccuaggcgaacucugcgaagacacuaucaccuacaaaugcccccuacuaagacaaaacgaacccgaagauauugacugcugguguaacagcacauccacgugggugaccuacggcacaugcacuaccaugggcgaacaccgacgcgaaaaacgcagcguagcccucguaccccacguaggcaugggacuagaaacccggacagaaaccuggaugagcagcgaaggggcauggaagcacguacaacggauagaaacauggauccucagacacccaggcuucaccaugauggcagcaauacucgccuacaccaucggaaccacgcacuuccaacgagcccuaaucuucauccuauuaacagcaguaacacccucaaugacgaugcgaugcaucggaaugucgaaccgggacuucgucgaaggcgugucagggggcucauggguagacauaguccucgaacacggcucaugcgugacaacaauggccaaaaacaaacccacauuagacuuugaacuaaucaagacagaggcaaaacaaccagcaacacucagaaaauacugcauagaagcgaaacuuacaaacaccacaacagaaucaaggugccccacccaaggcgagcccagccucaacgaagaacaagauaaacgguucgugugcaaacacucaaugguagaccgaggauggggcaacggaugcggacuauucgggaaaggaggcauagugaccugcgccauguuccgaugcaagaaaaacauggaaggaaaaguaguccaaccagagaaccuggaauacacaaucguaaucacaccacacagcggagaagaacacgccguaggaaacgacacgggcaagcacggaaaggaaaucaagauaacaccccaaucaagcauaacagaggcggaauuaaccggcuacggaacagucacaauggaaugcagcccaagaaccggccuggacuucaacgaaaugguacuccuccaaauggaaaacaaagccuggcucguacacagacaaugguuccucgaccugccgcucccauggcuaccuggagcagacacccaagguuccaacuggauccagaaagaaacccuagucaccuucaaaaacccacacgcaaagaagcaagacguuguaguccucggcucgcaagagggcgccaugcauacagcccucaccggagccacagaaauccaaaugagcagcggaaacuuacuguucacaggacaccuaaaaugccgacucagaauggacaaacuacagcucaagggcauguccuauagcaugugcacaggaaaauucaaagucguaaaagaaauagcagaaacgcaacacggcaccaucgucauucgcguccaauacgaaggcgacgguucaccaugcaaaauacccuucgaaaucauggaccuagagaaaagacacguccucggacggcucaucaccgucaaccccaucgucaccgaaaaagacucuccuguaaacaucgaagcggaacccccauucggcgacagcuacaucauuaucggcgucgaacccggccaacucaaacucaacugguucaagaaaggaagcacacuugggaaagcauucagcacaacacucaaaggcgcacaaagacucgcagcacucggggacacggcaugggacuucggcagcaucgggggcgucuucaacuccauaggccgagcaguucaccaagucuucgggggagcauucaggacacucuucggcggaaugagcuggaucacgcagggacucaugggcgcccuccuacucuggaugggagucaacgccagagacagauccauagcccuagcauuccuagcgaccggaggcgugcuaguauuccuugcaacgaacguccacgcauga

SEQ ID NO: 2382 - RNA, 1332 nt, Artificial Sequence
  derived and/or modified CDS sequence (opt11) from DENV-2 CYD2-T__SSm-EdelTM
auguuccaacgcgcccuaauauucauccuccuaacagccguaaccccaucaaugacaaugcgcugcauaggcaugagcaaccgcgacuucguagaaggagucuccggcggaagcuggguagacaucguacucgaacacggcagcugcgucaccaccauggcgaaaaacaaacccacccuagacuucgagcugaucaaaacggaagcaaaacaacccgcaacccuccgaaaauacugcaucgaggcuaaacucacaaacacaacaacggaaagucgcugcccaacgcaaggagaacccagccuaaacgaggaacaggacaaacgcuucguuugcaaacacagcaugguagaccgcggguggggaaacggcugcggacucuuuggaaaaggcggcaucguuaccugcgcaauguucaggugcaagaaaaacauggaaggcaaagucgugcaaccggaaaaccucgaauacacuauaguaaucacaccccacagcggcgaagaacacgcagucggaaacgacaccggcaaacacggcaaagagauaaaaaucaccccgcaaucauccaucacagaagcagaacucaccggcuacggaacagucacaauggaaugcucgccacgaacgggacuagacuuuaacgaaaugguacuacuccaaauggaaaacaaagccuggcuaguacacagacaaugguuccucgaccuaccccuacccuggcuaccaggcgcggacacacaaggcagcaacuggauccaaaaggagacccucguaacauucaaaaacccacacgccaagaaacaagacgucgucguccuaggcagccaagaaggcgccaugcacacagcccuaaccggcgccacagaaauacaaaugagcagcggaaaccugcuguucacaggacaccuaaaaugccgccuaaggauggacaaacuacaacugaaaggcaugagcuacuccaugugcacaggaaaauucaaagucgucaaagaaaucgccgaaacccaacacggcacaaucguaauaagaguccaauacgaaggagacggaucccccugcaaaaucccauucgaaauaauggaccuagagaaaagacacguccucggaaggcucauaacgguaaaccccaucgugaccgaaaaagacagcccagucaacaucgaagcagaaccacccuucggggacagcuacaucaucaucggcguagaacccggccaacuaaaacuaaauugguucaagaaaggaagcucaauaggccaaauguucgaaaccacgaugcgcggcgcaaaacgcauggccauccucggagacacggccugggacuucggcagcuaa

SEQ ID NO: 2383 - RNA, 2379 nt, Artificial Sequence
  derived and/or modified CDS sequence (opt11) from DENV-2 CYD2-T__C-P2A-SSc-prME
augaacaaccaacgcaagaaggcgaaaaacacgccauucaacaugcugaaaagagagcgaaaccgcgucagcaccguacaacaacuaacaaagcgcuucucgcucggcaugcuacagggucgaggaccccucaaacucuucauggcacucguagccuuccuccguuuccuaaccauacccccaaccgccgguauccuuaaacgcuggggcaccaucaagaaaucaaaagcgaucaacguccuacgcggauucaggaaagaaaucggccgaaugcucaacauucucaaccggcgcagaagaaacuucgaccuacucaaacuggccggggacguagagagcaacccaggccccuccgcaggaaugauaauaaugcucauccccacaguaauggcguuccaccuaacgacccggaauggcgaaccccacaugaucgugucgcggcaagagaagggaaagucccuccucuucaagaccgaagacggaguaaacaugugcacccuaauggcaauggacuuaggcgaacucugcgaagacaccaucaccuacaaaugcccccuccuaaggcaaaacgagccggaagacauagacugcuggugcaacagcacaagcacgugggucacauacggaacgugcacuacaaugggcgagcaccgccgcgaaaaacgaagugucgcacucgugccacacgucgggaugggccuagaaacacguacggaaacauggaugucaucagagggcgcauggaagcacguacaacgcaucgaaaccuggauacuucgccaccccggauuuaccaugauggcugcgauacuagcauauacuauagggacaacacacuuccagcgggcacuaaucuucauccuacuaacagccgucacacccagcaugaccaugcgcugcaucggaaugucaaaccgagacuucguagaaggagucagcgguggcagcuggguagacauagugcucgagcacggaucaugcgucaccacaauggccaaaaacaaaccaacacucgacuucgaacuaauaaagacagaagcaaaacaacccgccacccugagaaaguacugcaucgaagccaaacugaccaacacgacaaccgaauccaggugcccaacacagggagaaccgucacucaacgaagaacaagacaaaagauuuguaugcaaacauucaauggucgaccgcggcuggggaaacggaugcggccucuucggaaaaggaggaaucgucacgugcgcaauguucagaugcaaaaagaacauggagggcaaagucguacaaccagagaaccuagaguacacgaucgucauaaccccacacagcggagaagaacaugcuguggguaacgacaccggaaaacacggaaaagaaaucaaaaucaccccgcaaagcagcaucacggaagccgaacucacaggauacgguacugucaccauggagugcagcccaagaaccggacucgacuucaacgaaauggucuugcugcaaauggaaaacaaggcauggcugguccacagacaaugguuccuagaccuaccccuccccuggcucccaggagccgacacccaaggcuccaacuggauccagaaagaaaccuuagucaccuucaagaacccccacgcaaagaaacaagacgucguaguccuaggcagucaagagggagcaaugcacaccgcacuaaccggagcuacggaaauccagaugagcagcggaaaccuacucuucacagggcaccucaaaugccgccuacgcauggacaaacuccaacuaaaaggaaugagcuacagcaugugcaccggaaaauucaagguuguaaaagaaauagccgagacccaacacggaacaaucgucauacgcguacaauacgagggagacgggucgcccugcaaaauaccguucgaaauaauggaccuagaaaagcgacacguccuaggaagacucaucacggucaacccaauagucacagaaaaagacagucccguaaauaucgaagcagaaccacccuucggagacagcuacaucaucaucggaguggaacccggacaacuaaaacuaaacugguucaaaaagggaucgagcaucgggcaaauguucgaaaccacaaugagaggcgcgaagcggauggccauccucggggacaccgcaugggacuucggaagccucggugguguguucacauccaucggaaaagcacuacaccaagucuucggagcaauauacggcgcagccuucaguggcguauccuggacaaugaagauccugaucggagucaucauaaccuggauagggaugaacucccgaagcaccucccuaagcgucacacugguacucgucggcaucguaacgcuguaccuaggcguaauggugcaagccuaa

SEQ ID NO: 2384 - RNA, 2043 nt, Artificial Sequence
  derived and/or modified CDS sequence (opt11) from DENV-2 CYD2-T__SSopt-prME(F108S)
augaaacgcaagaaaucagcaggcaugaucaucaugcugauacccaccgucauggccuuccaccuaacuaccagaaacggcgaaccgcacaugauuguaagccggcaagaaaaaggcaaaagccuucuguucaaaaccgaggacggggucaacaugugcacacucauggcaauggaccuaggcgaacugugcgaagacaccaucacguacaaaugcccccuacuaagacagaacgaaccagaagacauagacugcuggugcaacagcacaagcaccuggguaaccuacggaaccugcaccaccaugggcgagcaccgccgagagaaaagaucggucgcccucgucccccacguuggcaugggacucgagacccgcaccgaaacauggaugaguagcgaaggcgccuggaaacacguacaaagaaucgaaaccuggauccuaagacaccccggauucaccaugauggccgcaauccuagcauacacaauaggcaccacccacuuccaacgagcccugauauucauccuccucacagcaguaaccccgucaaugacgaugcgcugcaucggcauguccaaccgcgacuucgucgagggagucagcggcggauccugggucgacauaguccucgagcacggcagcugcguaaccacaauggccaaaaacaaaccgacacuagacuucgaacuaaucaaaaccgaagcaaaacaaccagcaacccuacgaaaauacugcauagaggccaaacucacaaacaccacaacagaauccagaugcccgacacaaggagagccgagccucaacgaagaacaagacaaacgauucgucugcaaacacaguauggucgaucgaggauggggaaacggcugcggacugagcggcaagggaggcauagugacaugugcaauguuccgaugcaagaagaacauggaaggaaaagucguacaaccugagaaccuagaauauacaauagucaucacgccccacagcggagaggagcacgcggugggcaacgacacaggcaaacacggaaaagaaaucaagauaacaccacaauccagcaucaccgaagcagaacucaccggauacggcacaguaacaauggagugcagcccgcggacaggacuggauuucaaugaaaugguacuacuccagauggagaacaaagcauggcucguacaccgccaaugguuccuagaccuaccccuacccuggcucccaggagccgauacgcaaggcuccaacuggauccaaaaggaaacucuaguaacauuuaaaaacccccaugccaagaaacaggacgugguaguccuaggaagccaagaaggcgccaugcacacagcccuaacaggcgccaccgaaauacaaaugagcagcggcaaccugcuauucaccgggcaccucaaaugccgccuacgcauggacaaacuccaacucaaagggaugucguacagcaugugcacagggaaauuuaaagucgugaaagaaaucgccgaaacgcaacacgggacaaucgucauacgaguacaguacgagggcgacgguucacccugcaaaauccccuucgagauuauggaccuggagaaaagacacguacucggaagacucaucacagucaacccaaucguaaccgagaaagacagcccagucaacauagaagcagaacccccguucggagacagcuacauaauaaucggagucgaaccaggacaacuaaaauuaaacugguucaagaaaggaaguucaaucgggcaaauguucgagacgaccaugagaggcgccaaacgaauggcaauccugggcgacacagcaugggacuucggcucccuagguggagucuucacgagcaucggaaaagcauuacaccaagucuucggagcaaucuauggcgccgcauucagcggcguaaguuggaccaugaaaauacuaauuggcgucaucaucaccuggaucggcaugaacucccgcagcaccucgcucagcgucacgcuaguucucgucggaauagugacacucuacuuaggcgucaugguccaagcauga

SEQ ID NO: 2385 - RNA, 2043 nt, Artificial Sequence
  derived and/or modified CDS sequence (opt11) from DENV-2 CYD2-T__SSopt-prME(M96H)
augaaacgcaagaaauccgcagggaugaucaucaugcuaauacccaccguaauggccuuccaccuaacuacacgaaacggcgaaccccacaugaucguaagccgccaagagaagggaaaaagccuccucuucaaaaccgaggacggcgucaacaugugcacacucauggccauggacuuaggagaacucugcgaagacaccaucaccuacaaaugcccccuccucagacaaaacgaacccgaagacauagacugcuggugcaacucaacaagcacauggguaacauacggaaccugcaccaccaugggcgagcaccgccgcgaaaaacgcuccguagcccuagucccacacgugggcaugggccuagaaacacgcacagaaaccuggauguccucggagggagccuggaaacacguacaaagaauagaaaccuggauacucaggcacccaggcuucaccaugauggcugcaauacucgcguacacaaucggaacaacgcacuuucagcgggcccugaucuucauauuacuaacagccgucacccccagcaugaccaugcgcugcaucggcaugagcaacagagacuuuguagaaggagucagcggcgguagcuggguagacauaguccucgaacacggaucaugcgugaccacaauggcgaaaaacaaaccaacacuagacuucgaacucaucaagacagaggccaaacaacccgccacacuccgcaaauacugcaucgaagcgaagcugaccaacaccacgacagaaagcagaugcccuacacaaggagaaccaucacuaaacgaagaacaagacaaaagauucguaugcaaacacucacacguagaccgcggcuggggcaauggcugcggacuauucggaaagggcggcauaguaaccugcgcaauguuccgaugcaagaaaaacauggaaggcaaaguaguccaacccgaaaaccucgaauacacaaucgucaucacaccacacaguggagaggaacacgcagucggaaacgacacaggaaaacacggcaaagagaucaaaaucaccccacaaagcucaauaaccgaagcagaacugaccggauacggaaccguaacaauggaaugcagcccccgaaccggccuagacuucaacgaaaugguacuacuccaaauggagaacaaagcgugguuaguacaccggcaaugguuccuagaccucccgcuaccguggcuaccaggugcagacacacaaggaagcaacuggauccaaaaagaaacccucgucacauucaaaaacccccacgcgaaaaagcaagacgucguaguccucggaucccaagagggagcgaugcacacagcccucacuggcgcaacagagauacaaauguccagcggaaaccuccucuucaccggacaccucaaaugccgccuacgaauggacaaacuucaacucaagggcaugagcuacagcaugugcacgggcaaguucaaaguaguaaaagaaaucgcggaaacacaacacggaaccauugucauccgaguccaauacgaaggcgacggaucacccugcaaaauaccauucgaaauaauggaccuggaaaagagacacguacuuggacgccucaucaccgucaaccccauaguaacagaaaaggacucaccagucaacaucgaagcagaaccacccuuuggcgacagcuacauaauaaucggaguagaaccugggcaacucaagcugaacugguucaagaaaggaucaagcaucggccaaauguucgaaacaaccaugagaggcgcgaaacgaauggcaauccucggcgacacagcaugggacuucggaucccucggggguguauucacauccaucggcaaagcacuacaccaagucuucggggccauauacggagccgcauucagcggcgucagcuggaccaugaagauacugauaggaguaauaauaaccuggaucgggaugaacaguaggagcacgucacuaagcgugacucuaguccuagucggaauugucacucucuaccuaggcguaaugguccaggccuaa

SEQ ID NO: 2386 - RNA, 2043 nt, Artificial Sequence
  derived and/or modified CDS sequence (opt11) from DENV-2 CYD2-T__SSopt-prME(S186F)
augaagcgcaaaaaguccgccggaaugauaauaaugcucauccccaccgucauggccuuucaccugacaacccgaaacggcgaaccacacaugauagugagccggcaagaaaaaggcaaaagccugcuguucaaaacagaagacggagucaacaugugcacccuaauggccauggaccuaggagaacucugcgaagacacaauaaccuacaaaugccccuuacuccgacaaaacgaaccagaagacauagauugcuggugcaacagcaccagcaccugggucaccuacggaacaugcacaaccaugggagaacacagacgagagaaaagaucaguagcacugguaccgcacguuggaaugggacuagaaacacgaacagaaacauggaugucaagcgaaggcgccuggaagcacguccaacggaucgaaacauggauacuaaggcacccgggcuucacaaugauggccgcaauacuagcauauacaauaggcacaacgcacuuccagagggcccuaauauuuauauuacugaccgcaguaacaccaagcaugacaaugagaugcaucggaauguccaacagggacuucguagaaggcgugagugggggcucauggguagacaucgucuuagaacacgggagcugcguaaccacgauggccaaaaauaaaccaacccuagacuucgaacugauaaaaacugaagccaagcaaccagccacgcuccggaaauacugcauagaagccaaacuaaccaacaccacgaccgaaagccgcugcccaacccaaggcgaacccucgcugaacgaagaacaggacaaaagauucgucugcaagcauagcaugguagacagaggauggggcaacggcugcggccuguucggaaagggaggcauagucacaugcgcaauguuccgaugcaaaaagaacauggaaggaaagguaguccaaccggaaaacuuagaauacacaauagucauaacgccacacucgggcgaagaacacgcaguagggaacgacacaggaaaacacggcaaagaaaucaagauaaccccucagagcagcaucacagaagcagaauuaaccggguauggcacaguaaccauggaaugcuucccccgcacgggacuagacuucaacgaaaugguacuccugcaaauggaaaacaaagcauggcuaguccaucgccaaugguuccuugaccuaccccugccguggcuacccggagccgacacacagggcucaaacuggauacaaaaagagacccucgugacauucaagaacccccacgccaagaaacaagacgucgucguacucggaucccaggaaggcgcaaugcacacugcacuaaccggcgcaaccgaaauccaaaugagcagcggcaaccuacuauucaccggccaucucaaaugccgccuccgaauggacaaacuccaacuaaaaggaaugagcuacagcaugugcaccggcaaauucaaagucguaaaagaaaucgcggagacacaacacggcacaaucguaauccgcguacaauacgaaggagacggaagccccugcaaaauacccuucgaaaucauggaccucgagaaaaggcacguacucgggcgacugaucaccgucaacccaauagucaccgaaaaggacagcccagugaacaucgaagcggagccacccuuuggcgacagcuacaucauaaucgggguggaaccaggacaauugaaacugaacugguucaagaaaggcagcucgaucgggcagauguucgagacaacgaugcgaggcgcaaaacgaauggccaucuugggagacacagcgugggacuucgggagccugggcgggguauucaccuccaucggcaaagcacuccaccagguauucggggccaucuacggugccgcauucucaggcguaagcuggaccaugaagauccucaucggcgucauaauaaccuggauaggcaugaacaguagaagcacgagccugagcgugacccuaguccucguaggcauagugacccucuaccuaggcgugauggugcaagcauga

SEQ ID NO: 2387 - RNA, 2043 nt, Artificial Sequence
  derived and/or modified CDS sequence (opt11) from DENV-2 CYD2-T__SSopt-prME(R188L)
augaaacgaaagaaaagcgcaggaaugauaaucaugcucaucccuacaguaauggccuuccaccucacaacaagaaacggagaaccgcacaugauagucagcagacaagagaaaggcaaaagucuccuauucaagaccgaagacggcguaaacaugugcacacuaauggcuauggaccucggagaacuaugcgaagacacgaucaccuacaaaugcccccuacugcgacagaacgaacccgaagacauagacugcuggugcaacuccacaagcacaugggucacguacggaacaugcaccacgaugggagaacacaggagagaaaaacgcucaguagcacucgucccccacgugggaaugggacucgaaaccaggaccgagaccuggaugagcagcgaaggagcauggaaacacguacaaaggaucgaaaccuggauccuccggcacccaggauucacgaugauggcagcaauacuagcauacacaauaggcaccacccacuuccagcgagcgcuaaucuucauacuacucacggcggucacacccagcaugacaaugcgaugcauaggcaugagcaaccgcgacuucguggagggcguauccggaggaagcuggguagacauaguccuagaacacggaagcugcguaacgaccauggcgaaaaacaaacccacccucgacuucgaacuaaucaaaacggaggccaaacaacccgcaacacuacgcaaauacugcauagaagcgaagcuaacaaacaccacaacagaaucacgaugccccacccaaggcgaaccaagucuuaacgaagaacaggacaagcgauuuguaugcaaacacagcauggucgaccgaggcuggggaaacggcugcggccuguucggaaagggcggcaucgugacgugcgcaauguucaggugcaagaaaaacauggaaggaaaagucgugcagcccgaaaaccuggaauacacgauagucaucaccccucacagcggcgaggaacacgcggucggaaacgacaccggaaaacaugggaaagagaucaaaaucacaccccaauccagcauuaccgaagccgagcuaaccggcuacggaacgguaaccauggagugcagcccgcuaaccggacucgacuucaaugaaaugguccuacuacaaauggaaaacaaggcauggcucguccaccgacaaugguuccucgaccucccccucccauggcuacccggcgccgacacccagggcuccaacuggauacaaaaagagacgcucgucacauucaaaaacccucacgcgaagaagcaagauguggucguacuaggaagccaggaaggcgcaaugcacacagccuuaacaggcgccaccgaaauccaaauguccagcggcaaccuucucuucacggggcaccugaaaugcagacugagaauggacaaacugcaacucaaaggaaugagcuacucaaugugcacaggcaaauucaaagucguaaaggaaaucgccgagacccaacacgggaccauagucauaagaguacaauacgaaggggacggcagcccgugcaaaaucccuuucgaaauuauggaccuugaaaaacgccacguccuaggccgacuaauaaccguaaaccccauagugacagagaaagauucccccguaaacauugaagcagaaccaccguucggagacagcuacauaauaauaggcgucgaaccgggccaacucaaacuaaacugguucaagaaaggcagcagcaucggacagauguucgaaacgaccaugcgcggagcaaaacgcauggcaauacuaggcgacacagccugggauuucggaagccuaggagggguauucacaucaaucggcaaggcacuccaccaagucuucggcgcaauuuacggcgccgcauucagcggaguaucguggacgaugaaaauccuaaucggagucauaauaaccuggauaggcaugaacucgcgcaguacaagccucucggucacccuagugcuggucggaauaguaacccuauaccucggagucauggugcaagcauaa

SEQ ID NO: 2388 - RNA, 2043 nt, Artificial Sequence
  derived and/or modified CDS sequence (opt11) from DENV-2 CYD2-T__SSopt-pr(D104A)MEdelstem_TM,(F108S)-JEV
augaaacgaaagaaauccgccggaaugauaaucaugcugaucccaacaguaauggcauuccaccucacuacccggaacggcgaaccacacaugaucgucucucgccaagaaaaaggcaaaagccucuuauucaaaaccgaggacggcgucaacaugugcacacucauggcaauggaccuaggcgagcugugcgaagacaccaucacauacaaaugcccccuccuucgccaaaacgagcccgaagacauagacugcuggugcaacaguacuucaaccuggguaacauacgggaccugcacaacuaugggcgagcaccgccgcgccaaacgaucagucgcccugguaccucacgucggaaugggccuagaaacacgcacagaaaccuggaugucauccgaaggcgccuggaaacacguacaacgaaucgaaacauggauccucagacacccaggcuucaccaugauggccgcaauacuagccuacaccaucggcaccacacacuuccaaagagcccucauauuuauacuacucaccgcggugacaccaucuaugaccaugagaugcauaggcauguccaaccgcgacuucguagaaggcguaagcggcggcucguggguagacaucguccuagaacacgggagcugcgucaccacaauggcgaaaaacaaaccaacccucgacuucgagcuaaucaaaacggaagcgaagcaaccagccacgcuccggaaauacugcaucgaagcgaaacucacaaacacaacgaccgaaagccgaugucccacccaaggagaaccaagccucaacgaagaacaagacaaacgcuucguuugcaaacacaguaugguagacagaggcuggggaaacggcugcggccugagugguaagggcggcauaguaaccugcgccauguuccggugcaagaaaaacauggaaggcaaagucguccaacccgaaaaccuagaguacacaauagucaucacgccccauagcggcgaagaacacgccguaggaaacgacaccggaaaacacggaaaagaaaucaaaaucaccccgcaaagcuccauaaccgaagcggaacucacaggauacggcacggucacaauggaaugcagcccccgcacaggccucgacuucaacgaaauggugcuacuacaaauggaaaacaaagcauggcuagugcaccgucaaugguuucuggaccucccccuacccuggcucccaggagccgacacccaaggcucgaacuggauacaaaaagaaacccucgucaccuucaaaaacccacacgccaagaaacaagacguggucguccuagggagccaggaaggagccaugcacaccgcacucaccggcgccaccgaaauccagaugucaagcggcaaucuccucuucacaggccaccucaaaugccgccuaagaauggacaaacuccaacuaaaaggaaugagcuacucaaugugcaccggcaaguucaagguaguaaaggaaaucgcagaaacccaacacgggacgaucguaaucagaguacaauacgaaggcgacggcagcccuugcaaaaucccauucgagauaauggaccucgaaaaacgccacguccuaggccgccuaauaaccgucaacccuaucguaacagaaaaggacagccccguuaacauagaagcagaaccgccauucggugacagcuacauaaucauaggcgucgaaccaggacaacuaaaacuaaacugguucaagaaaggaagcacacuaggaaaagcguucuccacaacguuaaaaggagcacaaagacuagccgcccucggcgacaccgcaugggacuucggauccauaggcggaguauucaacagcauuggccgagcaguacaccagguguucggcggcgccuucagaacccucuucgguggaauguccuggauaacgcagggacucaugggagcacuccuccucuggaugggaguaaacgcacgagaccggucaauagcacuggccuuccucgccaccgggggcguccuggucuuccuagcaacaaacguccacgccuag

SEQ ID NO: 2389 - RNA, 2043 nt, Artificial Sequence
  derived and/or modified CDS sequence (opt11) from DENV-2 CYD2-T__SSopt-prMEdelstem_TM,(H261N)-JEV
augaaacgaaagaaaagcgccggaaugauaaucaugcugauacccaccgucauggcauuccaucuaacaacacgcaacggcgaaccacacaugaucgucagccgccaggaaaaaggcaaaagccuacucuucaaaaccgaagacggcgucaacaugugcacacuuauggccauggaccugggcgaacuaugcgaagacacaaucaccuacaaaugcccccuacugagacaaaacgaaccagaagacaucgacugcuggugcaacagcacgagcacgugggucaccuacggaacgugcaccaccaugggcgagcaccgccgagaaaaacgaagcgucgcccugguaccccacgucggaaugggccuagaaacccgaacagaaacauggaugagcuccgaaggagccuggaaacacguacaacgcaucgaaacguggauccugagacacccuggcuucaccaugauggcagcaauauuagcuuacacaaucggaaccacacacuuccaacgcgcacuaauauucauacuacuaacagccgucacgcccagcaugacaaugagaugcauaggaaugucaaaccgagacuuuguagaagggguaagcgggggaagcugggucgacaucguacuggaacacggcucgugcgucaccacgauggccaaaaacaaaccaacccuagacuucgaacugaucaaaacagaagcaaaacaaccagcaacccuaagaaaguacugcaucgaagcgaagcuaacaaauaccacaaccgaauccagaugcccaacacaaggcgagcccagccucaacgaggaacaggacaaacgauucgucugcaaacacucgauggucgaccgcggauggggcaacggcugcggccuguuuggaaaaggcggaauagugaccugcgcgauguucagauguaagaaaaacauggaagguaaagucguacaaccggaaaaccucgaauacaccaucgugauaacaccccacuccggcgaagaacacgccgugggcaacgacaccggaaagcacggaaaagaaaucaaaauaaccccucaaagcagcauaaccgaagcagaacucaccggauacggaaccgucacaauggaaugcagcccgcgcacgggccucgacuucaacgaaaugguccuccugcaaauggagaacaaagcauggcucguccaccgccagugguuccucgaccucccccucccauggcuaccaggcgcagacacgcaggggagcaauuggauacaaaaagaaacgcuggucacauucaaaaacccccacgccaagaaacaggacgucgucguccucggaucacaagaaggcgcaaugaacaccgcacucaccggagcgaccgaaauccaaauguccucagggaaccuacucuuuacaggccauuuaaaauguaggcuccgcauggacaaacuacagcucaaaggcauguccuacucaaugugcacagggaaauucaaagugguaaaagaaaucgccgaaacacaacacggaacaauugugaucagaguacaauacgagggcgacggcucacccugcaaaauacccuucgaaauaauggaccuagaaaaacgacacguccuggggcgccugauaaccgucaacccgaucguaacagaaaaagacucucccgucaacaucgaagcggagccgcccuucggagauagcuacaucaucaucgggguggaacccggacaacugaaacuaaacugguucaagaaaggaagcacccucggaaaagcauucagcaccacccugaaaggcgcacaacgacucgcggcccugggcgauacagccugggacuucggauccaucggaggcguauucaacagcaucggcagagcaguccaccaaguuuucggaggggcguuccgaacacuauucggcggcaugagcuggauaacccaagggcuaaugggcgcacuccugcuauggaugggcguaaacgcacgcgaccggagcauagcacucgccuuccucgcaaccggcggcguccucgucuuccuggccacaaacgugcacgccuga

SEQ ID NO: 2390 - RNA, 2043 nt, Artificial Sequence
  derived and/or modified CDS sequence (opt11) from DENV-2 CYD2-T__SSopt-prMEdelstem_TM,(R188L,A267T)-JEV
augaagcgcaaaaagucugcaggcaugauaauaaugcuaauacccaccgucauggccuuucaccuaacaacgcgaaacggcgaaccgcacaugauagucucacgccaagaaaaaggcaagagccuacucuuuaaaacggaagacggcgucaacaugugcacccuaauggccauggaccucggagaacugugcgaagacacaaucaccuacaaaugcccccuacuccgccaaaacgaacccgaagacaucgacugcuggugcaacagcacgucaacaugggugacauacgggaccugcaccaccaugggcgaacacagacgagaaaaacgaagcguagcucucgucccccacguaggcaugggccuagaaacccgcacagaaacauggaugucauccgaaggcgccuggaaacacguucaacgcauagaaacauggauacuccgacacccaggcuucaccaugauggcagcaauccuagcauauacaaucggcaccacccacuuucaacgcgcacucauauucauccuacuaacagccguaacccccucaaugacaaugcgcugcauaggcauguccaaccgagacuucgucgaaggagucagcggaggaucaugggucgacaucguccuagaacacggcucaugcguaacaacaauggccaaaaacaagccaacgcuggacuucgaacugaucaaaacagaggccaaacaaccagcaacgcugcgaaaguacugcauagaagcaaaacucaccaacaccacaacugaaagccgcugcccaacacaaggcgagccaagccucaacgaagaacaagacaaaagauucgucugcaaacacagcauggucgacagggguuggggaaacggcugcggccuauucggaaaaggcggcauaguaacaugcgcaauguucagaugcaagaaaaacauggaggggaaagucguacagcccgaaaaccuggaauacaccaucgucauaacaccacacucaggcgaagaacacgccgucggcaacgacacaggcaagcacggaaaagaaauaaagauaaccccacaaagcagcaucacagaagcagaacucaccggcuacgggaccgucaccauggaauguucgccgcucacaggccuugacuucaacgaaaugguguuacuacagauggaaaacaaagcauggcucguccaccgacaaugguuccucgaccuaccccuccccuggcuuccaggcgccgacacccagggcagcaacuggauccaaaaggaaaccuuagucaccuucaaaaacccgcacgcaaagaaacaagacgucgugguacuuggcagccaggaaggagcgaugcacaccgcacucaccggcacaacggaaauacaaaugagcuccgggaaccuacucuucacagggcaccucaaaugccggcuccggauggacaaacuacaacuaaagggaauguccuacucuaugugcaccggcaaguucaaagucguaaaagaaaucgccgaaacccaacacggcacgauugugaucagaguacaauacgaaggagauggcagccccugcaaaauccccuucgaaauaauggaccuagagaaaagacacguacucggcagacugauaaccgucaaccccauaguaacagaaaaagauagcccagucaacaucgaagcagaaccaccauucggcgacagcuacaucauaaucggagucgaaccaggacagcuaaaacucaacugguuuaaaaagggaagcacacuuggcaaagcauucucaacaacgcucaaaggcgcacaacggcucgccgcccuaggcgacaccgcgugggacuucggcaguaucggcggaguauucaacucaaucggacgcgcaguccaccaggucuucggaggcgccuuccgaacacuauucggaggcaugagcuggaucacgcaaggccuaaugggagcgcugcuauuauggauggggguaaacgcccgcgaccggaguauagcccuggcauuccucgccacugggggcgugcucgucuuccuagcaacaaacguacacgcguaa

SEQ ID NO: 2391 - RNA, 297 nt, Artificial Sequence
  derived and/or modified CDS sequence (opt11) from DENV-4 Consensus__C
augaaccaacgcaaaaaagucguccgcccccccuucaacaugcucaaacgcgaacgcaaccgcgucuccaccccccaaggccuagucaaacgcuucuccaccggccucuucuccggcaaaggcccccuccgcaugguccucgccuucaucaccuuccuccgcguccucuccauccccccaaccgccggcauccucaaacgcuggggccaacucaaaaaaaacaaagccaucaaaauccucaucggcuuccgcaaagaaaucggacgcaugcucaacauccucaacggccgcaaacgc

SEQ ID NO: 2392 - RNA, 339 nt, Artificial Sequence
  derived and/or modified CDS sequence (opt11) from DENV-4 Consensus__C-SSc
augaaccaacgcaaaaaagucguccgcccccccuucaacaugcucaaacgcgaacgcaaccgcgucuccaccccccaaggccucgucaaacgcuucagcaccggccucuucuccggcaaaggcccccuccgcaugguccucgccuucaucaccuuccuccgcguccucuccaucccccccaccgccggcauccucaaacgcuggggccaacucaaaaaaaacaaagccaucaaaauccucaucggcuuccgcaaagaaaucggccgaaugcucaacauccucaacggacgcaaacgcuccaccaucacccuccucugccucauccccaccgucauggcc

SEQ ID NO: 2393 - RNA, 273 nt, Artificial Sequence
  derived and/or modified CDS sequence (opt11) from DENV-4 Consensus__pr
uuucacuugagcacgcgcgauggcgagcccuugaugauagucgcgaaacaugaaagaggcaggcccuugcucuuuaaaacgaccgagggcauaaacaagugcacgcucauagccauggacuugggcgagaugugugaagauaccgugaccuauaaaugucccuugcucgugaacacggaaccggaagauaucgacugcuggugcaaucucacgagcacgugggugauguauggcacgugcacgcaaucgggcgagcgcaggcgcgagaaaagg

SEQ ID NO: 2394 - RNA, 225 nt, Artificial Sequence
  derived and/or modified CDS sequence (opt11) from DENV-4 Consensus__M
agcguggccuugaccccgcacucgggcaugggcuuggaaacgcgcgcggaaacguggaugagcucggaaggggccuggaaacaugcccagcgcguggaaucguggauacucaggaacccgggcuuugccuugcucgcgggcuuuauggcguacaugaucgggcaaacgggcauacaaaggaccguguucuuuguccugaugaugcucguggccccgagcuauggc

SEQ ID NO: 2395 - RNA, 498 nt, Artificial Sequence
  derived and/or modified CDS sequence (opt11) from DENV-4 Consensus__prM
uuccaccuauccacacgcgacggcgaaccccucaugaucgucgccaaacacgaacgcggccgcccccuccucuucaaaaccaccgaaggcauaaacaaaugcacccucaucgccauggaccucggcgaaaugugcgaagacaccgucaccuacaaaugcccccuccucgucaacaccgaacccgaagacaucgacugcuggugcaaccucaccuccaccugggucauguacggcaccugcacccaaucaggcgaacgccgccgcgaaaaacgcuccgucgcccucaccccccacuccggcaugggccuagaaacccgcgcagaaaccuggauguccuccgaaggcgccuggaaacacgcccaacgcgucgaaucauggauacuccgaaaccccggcuucgcccuccuagccggcuucauggccuacaugaucggccaaaccggcauccaacgcaccguauucuucguccucaugaugcucgucgcccccuccuacggc

SEQ ID NO: 2396 - RNA, 1485 nt, Artificial Sequence
  derived and/or modified CDS sequence (opt11) from DENV-4 Consensus__E
augagaugcgugggcguagggaacagagacuucgucgaagggguaagcggcggggcauggguagaccucgugcuagagcacggaggcugcgugacaacgauggcgcagggaaagccgacacuggacuucgagcucaccaaaacgacggcaaaggagguagcgcuccuaagaacguacugcaucgaggcgucgaucagcaacauaacaacggcaacgaggugcccaacgcaaggagagccauacuugaaagaagaacaggaccagcaguacauaugccgaagagacguaguagaccgaggauggggaaacgggugcggacuguucggaaagggaggcguagugaccugcgccaaguucagcugcagcgggaagauaacggggaaccucgugcaaauagaaaaccuagaguacacgguagugguaacaguccacaacggggacacgcacgcgguaggcaacgacacgagcaaccacgggguaacagcaaccauaaccccgcgaaguccaucgguggaagugaagcugccagacuauggagaacucacacuggacugcgagcccaggagcgggauagacuucaaugaaaugauauuaaugaaaaugaaaaagaagacauggcucguacacaagcaaugguuccuagaccugccacuaccguggacagcaggagcggacacgagugaaguacacuggaacuacaaggaaagaauggugacauucaaagugccacacgcaaagagacaggacguaacggugcugggaagccaagagggggcaaugcacagcgcacuggcgggagcaacggaagucgacagcggagacggaaaccacauguucgcgggacaccuaaaaugcaagguaaggauggagaaacugagaauaaaagggaugagcuacacaaugugcagcgggaaauucucaauagacaaggaaauggccgagacacaacacggaacaacgguagugaagguaaaauacgaaggggcaggagcgccgugcaaagucccgauagaaauaagggacgugaacaaggaaaaaguagucgggaggguaauaaguagcacaccacucgcagaaaacaccaacagcguaacaaacauagaacuagagccaccauucggagacucauacauagugauaggagugggcaacagcgcccuaacacuacacugguucaggaaaggaagcagcauaggaaagauguucgaaagcaccuacagaggagcgaaacgaauggcgauacuaggggaaacagcaugggacuucggaagcguaggaggccuguucacaagccuaggaaaggcggugcaccaagucuucgggagcguauacaccacgauguucggaggggugagcuggaugauaagaauacugauaggguuccugguacuauggauagggacgaacaguagaaacacgucaauggcgaugacgugcauagcaguaggcgggauaacgcuauuccuaggauucacaguacaagca

SEQ ID NO: 2397 - RNA, 1983 nt, Artificial Sequence
  derived and/or modified CDS sequence (opt11) from DENV-4 Consensus__prME
uuucaccuguccacgcgcgacggagagccccucaugauagucgcgaaacacgaaagaggacgaccacuacucuucaaaaccacggaaggaauaaacaaaugcacacuaauagcgauggaccuuggagaaaugugcgaagacacggugacauacaagugcccccuccuaguaaacacagaaccagaagauauagacugcuggugcaaccuuacgagcacaugggugauguacggcacaugcacacaaucaggcgaaaggcgaagagaaaaacgaucggucgcguuaaccccgcacagcggcaugggcuuggaaacacgagcagaaacguggauguccagcgaaggagcauggaaacacgcgcaacgcgucgaaagcuggauacuaaggaaccccggcuucgcacuccucgcaggguucauggcguacaugaucgggcaaacggggauacaaagaacaguguucuucguacuaaugaugcuaguggcaccaagcuacggcaugcgcugcgucggagucggcaacagagacuucgucgaaggugugagcggaggagcauggguagaccucguacuagagcacggaggcugcguaacaacaauggcgcaaggaaaaccaacauuggacuucgaacugaccaaaaccaccgccaaagaagucgcccugcugagaaccuacugcaucgaagcaagcaucagcaacaucacgaccgcgacgagauguccaacgcaaggggaacccuaccucaaggaagaacaagaccaacaguacauaugcagacgagacgugguagaccgaggauggggaaacggaugcggccuguucgggaaaggaggcguaguaaccugcgcgaaauucagcuguagcggaaaaauaaccggaaaccuaguccagaucgaaaacuuagaauacacagucgucgucacaguacacaacggagacacccacgccgucggaaacgauacaaguaaccacgggguaacggcaaccauaacgccgagaagcccgagcgucgaggugaaacuccccgacuacggagagcugacauuagacugcgaaccacggagcggcauagacuucaacgaaaugauccuaaugaaaaugaaaaagaaaacguggcuagugcacaaacagugguuccucgaccuaccgcuaccauggacagccggggcagacacaucagagguacacuggaacuacaaagaacgaaugguaacauucaaagucccacacgcaaaaagacaagacgugacgguacugggaagccaggagggcgcaaugcacagcgcgcuggcaggcgcgacggaagucgacagcggagacggaaaucacauguucgcaggacaucuaaagugcaagguccgcauggaaaaacucaggauaaaagggaugagcuacacgaugugcagcggcaaauucagcaucgacaaagaaauggcagaaacacaacacggcacgaccgugguaaaggugaaauacgaaggcgccggcgcaccaugcaaagugcccauagaaauccgagacgucaacaaggaaaaaguagucggacgcgugaucagcucaacaccacuagcggaaaacacaaacagcguaacaaacauagaacuagaaccaccauucggcgacagcuacauaguaauaggaguagggaacagcgcccucacacuccacugguucagaaaaggaagcagcauagguaaaauguucgaaagcacauaccggggagcaaaaaggauggcgauccucggugagacagcgugggacuucggaagcguaggagggcuauucacaucgcucgggaaggcaguacaccaaguauucggaagcguauacacgacaauguucggcggagugagcuggaugauaaggauucuaauaggcuuccuaguacuguggauaggaacaaacuccaggaacacgucaauggccaugaccugcaucgcagucggaggcaucacacuauuccuaggguucacaguacaagca

SEQ ID NO: 2398 - RNA, 2025 nt, Artificial Sequence
  derived and/or modified CDS sequence (opt11) from DENV-4 Consensus__SSc-prME
agcacaauaacacuccucugccucauaccgacggucauggccuuccaccuaaguacacgagauggagaaccccugaugauaguagcgaagcacgaaaggggccgcccccugcuguucaagacgaccgaaggcauaaacaaaugcacguuaauagccauggaccugggagaaaugugcgaggacaccgugacguacaaaugcccgcuccuaguaaacacggagccggaagacauagacugcuggugcaaucuaacaagcaccugggugauguaugggaccugcacgcagagcggcgaacggaggagagaaaaacgaagcguggcgcugaccccgcacagcggcaugggccuggaaacacgcgccgaaacauggaugagcagcgaaggagcauggaaacacgcccagcgaguagaaagcuggauacucagaaacccaggcuuugcccuucucgcgggauucauggcguacaugaucggacaaacaggaauacaaagaacagucuucuucguacugaugaugcuaguagccccaagcuacggcaugcgaugcgucggagucgggaacagagacuucgucgaaggcgugaguggaggagcguggguugaccuaguccuagaacacggcggcugcgugacuacaauggcacaaggaaaaccaacgcuggacuucgaacucacaaaaaccacggccaaggaaguagccuugcuuaggacauacugcaucgaagcgagcauauccaacaucacgaccgcgacuagaugcccgacgcaaggcgaaccauaccuaaaagaggagcaggaccaacaauacauaugccgacgagauguaguggacagagguuggggaaacggaugcggacuguucggaaaagggggaguagucacgugcgcaaaauucagcugcagcgggaaaaucaccgggaaccuaguacaaaucgagaaccuggaauacacgguggucgugacaguccacaacggggacacacaugcggucggcaaugacacgagcaaccacggaguaacagcaacaauaacgccacggagcccaagcguggagguaaaguuacccgacuacggagaacuaacacuagacugugaaccacgcucaggcauagacuucaacgaaaugauccuaaugaaaaugaaaaagaaaacauggcuaguccacaaacaaugguuccuggaccuuccgcucccguggacagcaggagccgacaccagcgaggugcacuggaacuauaaagagagaauggucacguucaaagugccgcacgcaaaaagacaagacgugacaguccuagggucacaagaaggcgcgaugcacagcgcccuugcgggcgccacugaaguagacagcggcgacggaaaccauauguucgcaggacaucugaaaugcaaagugcggauggaaaagcuacgaauaaagggcaugucguacaccaugugcucgggcaaguucagcaucgacaaagagauggcagaaacccaacacggaacuaccguggugaaggucaaguacgaaggggcaggagcgccaugcaaaguaccaaucgaaauacgagacgucaacaaggagaaagugguaggaagagugaucucgagcacgccccucgcagaaaacacgaacagugucaccaacauagaacuggaaccaccauucggagacagcuacauaguaauaggaguaggaaacagcgcacucacacuacacugguucaggaagggaagcucaaucgggaaaauguucgagagcacauacagaggcgcaaaaagaauggcgauccugggcgagacagcgugggacuucggaagcgucgggggacucuucaccagccucggaaaagcgguccaccaaguguucggcagcguauacaccacgauguucggaggaguaagcuggaugauacgaauacuaauaggcuuccuuguccucuggaucgggacgaauagcagaaacacaucaauggccaugaccuguauagcagucggggguauaacacuguuucuaggauucaccguacaagcc

SEQ ID NO: 2399 - RNA, 2322 nt, Artificial Sequence
  derived and/or modified CDS sequence (opt11) from DENV-4 Consensus__C-prME
augaaccaaaggaaaaaggucgucagacccccauucaauaugcucaaacgcgaacgcaaccgcguaaguacgccccaaggccucgucaaacgcuucagcacaggccucuucucagguaaaggcccacuacgaauggucuuagcauucaucaccuuccuccgaguccuguccauaccaccaacggccggcauacucaaacgcuggggccagcuuaagaaaaacaaagcaauaaaaauccugauaggauuccgcaaagagaucgggcgaaugcuaaacauccucaacggacgaaaacgcucgacgauaacacuccuaugccucauaccgacgguuauggcauuccaccugagcacacgcgacggcgaaccacucaugaucgucgcaaaacacgaacgaggcagaccccuucuauucaaaacgacagagggcaucaacaaaugcacacuaaucgccauggacuuaggcgaaaugugcgaagacacaguaacauacaaaugcccacuacugguuaacacagaaccagaagacauagacugcuggugcaaccuaaccagcaccugggucauguacggcacauguacacaauccggggaacgccgccgcgaaaaacgcagcguggcgcuaacgccacacagcggcaugggacucgaaaccagggcugaaacguggaugaguagcgaaggagcauggaaacacgcacagagagucgaaagcuggauacuucgaaacccaggcuucgcccuacucgcaggcuucauggcauacaugauaggacagaccggcauccaaagaacaguguucuucguccugaugaugcucgucgcccccagcuacggaaugcggugcgucggagucggaaauagggacuucgucgaaggaguaagcggcggcgccugggucgaccuaguccuagagcacggaggcugugucaccacaauggcacaaggcaaaccgacgcuggacuucgaacuaaccaaaacaacagccaaagaaguggcccuacugagaacauacugcauagaagcaagcauaagcaacaucacaaccgcgacccgaugcccaacccaaggcgaacccuaccuaaaagaagaacaagaccagcaauacaucugcaggagagaugugguagauagaggcugggggaacggaugcggacucuucgggaaaggaggagugguaacaugcgccaaauucuccugcuccggcaagauaaccggaaaccuaguacaaaucgagaaccuggaauacacggucgucguaaccguccacaacggagacacccacgcgguaggaaacgacacaagcaaucacggcgucacagccacuauaacacccaggagcccaagcguggaaguaaaacuaccagacuacggggagcucacauuagacugcgaaccacgcucuggaauagacuucaacgaaaugauacucaugaagaugaaaaagaaaacaugguugguccacaaacaaugguuccuagaccucccacucccguggacggcgggcgccgacaccuccgaaguccacuggaacuacaaagaacgcaugguaacguucaaagucccgcacgcaaaaagacaagacgucacaguucucgguagucaagagggcgcaaugcacagcgcccucgccggcgccaccgagguagacagcggagacgggaaccacauguucgccggacaccuuaaaugcaaaguacguauggagaaacuucgcauaaaaggcaugagcuacacuaugugcucaggcaaauucucaaucgacaaagaaauggccgaaacacagcacggcacaacagucguaaaaguuaaauacgagggcgcgggcgcccccugcaaggugccaauagaaauucgcgacgucaacaaggagaaaguugucggacgcguaauaucauccacaccccucgcagaaaacaccaacucaguaacgaacauagaacucgaaccaccuuucggcgacagcuacauagugauaggcgucgggaacagcgcccuaacacuccauugguucagaaagggaagcucaauuggaaaaauguucgagagcacauacagaggcgccaaaagaauggcaauucucggcgaaaccgcaugggacuucggcagcguaggcggccucuucaccucacucggaaaggcaguccaccaaguguucgggagcguguacacgacuauguucggcggcgucucauggaugauacgcauccucauaggguuccucguucuguggauaggcaccaacucacgcaacacaucgauggccaugaccugcaucgcagucggaggcaucacccuauuccucggauucaccguacaagca

SEQ ID NO: 2400 - RNA, 45 nt, Artificial Sequence
  derived and/or modified CDS sequence (opt11) from DENV-4 Consensus__SSc
auguccacaaucacccuccucugccucauccccaccgucauggcc

SEQ ID NO: 2401 - RNA, 57 nt, Artificial Sequence
  derived and/or modified CDS sequence (opt11) from DENV-4 Consensus__SSopt
augaaacgcaaaaaauccaccaucacccuccucugccucauccccaccgucauggcc

SEQ ID NO: 2402 - RNA, 57 nt, Artificial Sequence
  derived and/or modified CDS sequence (opt11) from DENV-4 Consensus__SSm
augauccaacgcaccgucuucuucguccucaugaugcucgucgcccccuccuacggc

SEQ ID NO: 2403 - RNA, 1488 nt, Artificial Sequence
  derived and/or modified CDS sequence (opt11) from DENV-4 Consensus__E
augcgcugcgucggagucggaaaccgagacuuuguagaagggguaagcggaggcgcauggguagaccugguccuagagcacggagggugcguaacaaccauggcacaaggcaaaccaacacuggacuucgaacuaacaaaaacaacggcaaaagaaguagcccuacuaagaaccuacugcauagaagcaagcauaagcaacaucaccacagcaaccagaugcccgacacaaggcgaacccuaccuaaaagaggaacaagaccaacaauacauaugcagacgagacgucguagacaggggcuggggaaacggcugcggacuauucgggaagggaggagucgucacaugcgcaaaauucaguugcagcggaaaaauaaccggaaaccucguccaaauagagaaccuggaauacaccguaguaguaacagugcacaacggcgacacacacgcagucggaaacgacacaagcaaccacggagucacggccacgaucacaccccgaagcccaaguguggaagugaaguugccagacuacggggaacugacccucgacugcgaaccgcgcagcggcauagacuucaacgaaaugauacucaugaagaugaaaaagaaaacauggcuaguccauaaacaaugguuccuggaccucccacucccguggacagccggagcagacaccagcgaagugcacuggaacuacaaagaaagaauggucacguucaaagucccacacgccaaaagacaagacgucaccguacuaggcucacaagaaggcgcaaugcacagcgcccuagcgggagcgacagaaguagacagcggagacggaaaccacauguucgccggacacuuaaaaugcaaaguccgcauggagaaacuaagaauaaaaggcaugagcuacacaaugugcucaggcaaauucagcaucgacaaagagauggcagaaacgcaacacggcacaaccguaguaaaggucaaguacgagggcgcaggcgcacccugcaaaguaccaaucgaaauaagagacgucaacaaagagaaaguagucggacgagucaucucaagcacaccacuggccgaaaacacaaacagugugacgaacauagaacucgagccgcccuucggcgacagcuacaucguaaucggagucggaaacucagcccuaacacugcacugguucaggaaaggcagcagcaucgggaaaauguucgagaguaccuacagaggcgcgaaacgaauggccauccuaggugaaacggcaugggacuucggaagcguaggagggcuauucaccucacuagggaaagcgguacaccaaguguucggcagugucuacacgaccauguucgggggcgugagcuggaugauaagaauacugauaggcuuccuagugcuauggaucgggaccaacagcagaaacacaagcauggcaaugaccugcaucgcgguagggggcauaacacuauuccuaggcuucacagugcaggcauga

SEQ ID NO: 2404 - RNA, 1182 nt, Artificial Sequence
  derived and/or modified CDS sequence (opt11) from DENV-4 Consensus__EdelTM-variant (aa1-394)
augagaugcguaggcguaggaaaccgcgacuucguagaaggcguaucaggaggagccugggucgaccucguacucgaacacggaggcugcgucacaacgauggcacaaggcaaacccacacuagacuucgaacucacaaaaacaaccgccaaagaagucgcacucuuaagaaccuacugcauagaagcgagcaucagcaacaucaccacagccacccgcugccccacccaaggcgaacccuaccugaaagaagaacaagaccaacaauacaucugccgaagggacgucguagaccgaggcuggggcaacggcugcggacucuucggcaaaggcggggucguaaccugcgcaaaauucuccugcaguggcaaaauaaccggaaaccucguccaaauagaaaaccuggaauacacaguagucguaacaguccacaacggcgacacccacgcagucggcaacgacacaagcaaccacggagucaccgcaacaauaacacccaggagccccagcgucgaggucaaacuaccagacuauggagaacuaacccuagacugcgagccacgaagcggaauagacuucaacgagaugauacuaaugaaaaugaaaaagaaaaccuggcucguccacaaacaaugguuccucgaccucccccuaccguggaccgccggcgcagacaccagcgaaguccacuggaacuacaaggaaaggaugguaaccuucaaagucccccacgcaaaacgccaagacgugaccguacuaggcucacaagaaggagcaaugcacagcgcacuagcuggcgcaacagaaguagacagcggcgacggaaaccacauguucgcgggacaccuaaaaugcaagguccgcauggaaaaacuccgcauaaaaggcaugucauacaccaugugcagcggcaaauucucaauagacaaggaaauggcagaaacacaacacggaacaacagucgugaaaguaaaauacgagggggccggagcacccugcaaaguacccaucgaaauaagagacgugaacaaagaaaaagucgucggcagaguaauaaguucaacaccccuagcagaaaacacaaauagcgugacaaacaucgaacucgagccacccuucggagacucauacauaguaauaggagucggcaacagcgcacugacacuccacugguuccgaaag

SEQ ID NO: 2405 - RNA, 1272 nt, Artificial Sequence
  derived and/or modified CDS sequence (opt11) from DENV-4 Consensus__EdelTM-variant (aa1-424)
augcgaugcguaggaguggguaacagagacuucguagaaggaguaagcggaggcgcguggguagaccuaguacuagaacacggaggaugcguaaccacaauggcacaaggaaaacccacccuagacuucgaacugaccaaaacgacagccaaagaagucgcgcuacugcgaaccuacugcauagaagccagcauaagcaacauaacgacagcgacgagaugcccaacccagggagaaccauaccuaaaagaggaacaagaccaacaauacauaugcaggcgggacgucguggaccgaggauggggaaacggcugcggccuauuugggaaaggaggcguagucacaugcgcaaaauucagcugcagcggcaaaauaacagggaaccucguacaaauagaaaaccucgaauacaccguaguaguaacaguacacaacggagacacacacgccguaggaaacgacacaagcaaccacggagucacagcaacaauaacaccaagaagcccaagcguagagguaaaacuaccggacuacggagaacucacauuagacugcgaacccagaucaggaauagauuucaacgagaugauacugaugaaaaugaaaaagaaaacauggcucguacacaaacaaugguuccuagaccuaccgcucccauggaccgcaggagcagacacaagcgaaguacacuggaacuacaaagagagaauggucacauucaaagucccacacgcaaaacgacaagacgugacaguacucggcagccaagaaggggccaugcacuccgcacuagcaggagcaaccgaagucgacucaggagacggcaaccacauguucgcaggacaccuaaaaugcaaaguacgaauggaaaaacuacgaauaaaaggaaugaguuacacaaugugcagcggaaaguucaguaucgacaaagaaauggcagaaacgcaacacgggacaacaguaguaaaaguaaaauacgagggagcgggcgcccccugcaaaguaccgauagaaauaagagacguaaacaaagaaaaaguaguaggaagagucauaagcagcacaccacucgcggaaaacacaaacagcgucaccaacauagaacucgaaccaccauucggcgacucauacauaguaauaggcguaggaaacagcgcgcuaacccuccacugguucaggaaaggaagcaguauuggaaaaauguucgaaagcacauacagaggcgcaaaaagaauggcgauacuaggagaaacugcaugggacuucgggagc

SEQ ID NO: 2406 - RNA, 1266 nt, Artificial Sequence
  derived and/or modified CDS sequence (opt11) from DENV-4 Consensus__EdelTM-variant (aa1-421)
augagaugcguaggaguagggaaccgggacuuuguagaaggagugagcggaggagcauggguggaccuaguauuggaacacggaggguguguaacgacaauggcgcaagggaaaccgacacucgacuucgaguuaacgaagacaacggcgaaagaaguggcccugcuaaggacauacugcauagaagcgagcauaaguaacauaacgaccgcaacgagaugcccaacacagggcgaaccauaucuaaaggaggagcaagaucaacaguacauaugcagaagagacgugguggacagagggugggggaacgggugcgggcuguucggaaaagggggagugguaacgugcgcaaaauucagcugcagcggaaagauaacagggaaccuaguacaaauagagaaccuagaauacacaguagugguaacagugcacaacggagacacacacgcagucggaaacgacacgagcaaccacgggguaacggcaacaaucacgccaaggagcccgagcguagagguaaaacuaccagacuacggagaacugacgcuggacugcgaaccgagaaguggaauagacuucaacgaaaugauacugaugaagaugaagaagaaaaccuggcuagugcacaaacagugguuccucgaccuaccgcugccauggacagcgggggccgacacaagcgaagugcacuggaacuacaaagaaaggauggugacauucaagguaccgcacgcgaaaaggcaagacguaacgguacugggaagccaggaaggagcaaugcacagcgcacuagcaggagcgacagaggucgacagcggggacgggaaccacauguucgcgggacaccuaaaaugcaaagugaggauggagaagcugagaauaaagggaaugagcuacaccaugugcaguggaaaguucaguauagacaaagaaauggcggaaacgcaacauggaaccacaguaguaaagguaaaauacgagggggcgggcgcgccauguaagguacccauagaaauaagagacgugaacaaggagaaagugguggggagggugauaagcagcacaccacuggcagagaacacgaacagcguaacgaacauagaacuggagccaccauucggggacagcuacauaguaauagggguagggaacagcgcgcugacacuacacugguuccggaaaggaagcagcauaggaaaaauguucgaaagcacguaccggggagcaaaaaggauggcaauacugggagagacagcgugggacuaa

SEQ ID NO: 2407 - RNA, 2031 nt, Artificial Sequence
  derived and/or modified CDS sequence (opt11) from DENV-4 Consensus__SSc-prME
augagcaccauaacccuacuaugccugauacccaccguaauggcauuccaccucagcacgcgcgacggggaaccacucaugaucguugcaaaacacgagcgcggccgcccacuccuguucaaaaccacagagggaauaaacaaaugcacacucaucgccauggaucuaggggaaaugugcgaagacacaguaacauacaagugcccgcucuugguaaacaccgaaccagaagacaucgacugcuggugcaaccucacaagcacaugggugauguacggaacaugcacgcagagcggagagcggcgaagagaaaaacgaagugucgcccuaacaccccacagcggaaugggacuagaaacacgagccgagaccuggauguccagcgaaggggcauggaaacacgcacaacgcgucgagagcuggauccuccgcaaucccggauucgcguuacucgcaggcuuuauggcauacaugauagggcagaccggaauccaacgcaccguauucuucguccuaaugaugcuaguagcgcccagcuacggaaugcgaugcgucggcgucggaaaccgagauuucguagaaggcgucagcgggggagcauggguggaccugguccucgaacacggcggcugcgucaccacgauggcacaaggcaaaccgacccuggauuucgagcucacgaaaacaacagccaaagaaguagcgcuacucagaaccuacugcauagaagcaagcauaagcaacauaacaacggcaacccgcugccccacacaaggcgaaccuuaccuuaaagaggaacaagaccaacaauacauaugcagaagagacgucgucgaccgcggcuggggcaacggcugcggccuauucggcaaaggaggaguaguaaccugcgcaaaguucagcugcucaggaaaaauaacgggcaauuuaguccaaaucgaaaaccuagaauacaccguaguaguaaccguacacaacggcgacacgcacgcaguaggcaacgacaccagcaaucacggcguaacagcaacaauaacaccaagauccccgucaguagaagucaaacuaccagacuacggcgaacugacacuagacugcgaaccaagaagcggcauagauuucaacgagaugauccucaugaaaaugaaaaagaaaaccuggcugguacacaaacagugguuccuagaccugccacuacccuggacagcaggagcagacaccagcgaaguccacuggaacuacaaagaacguauggucacauucaaaguaccacacgccaagcggcaggaugugaccguccuaggcagccaagagggagccaugcauucagcgcuugcaggcgcaacagaagucgacuccggagacggcaaccacauguucgcaggacaccuaaaaugcaaggucaggauggaaaaguuaagaauaaagggcaugucauacaccaugugcuccggaaaauucagcauagacaaggaaauggccgaaacacagcacggaacaacaguagucaaagucaaauacgaaggagccggggcacccugcaaaguacccaucgaaauacgagacguaaacaaagaaaaagucguaggacgggucauuucaagcacaccccuugccgaaaacaccaacagcgucaccaacauagaacucgagcccccauucggagacucauacaucguaaucggcgugggaaacagcgcccuaacacuucacugguuccgcaagggaaguucaauagggaaaauguucgaaagcaccuacagaggcgccaaaagaauggcaauacuaggagaaacggccugggauuucggaagcguaggcggacucuucaccucacuaggaaaagcaguccaccaaguauucggcagcgucuacacaaccauguucggaggagucucauggaugauacgcauauuaauuggcuuccucgucuuauggaucggcaccaacucacgaaacacaucgauggccaugaccugcaucgcggugggagguauaacccuguuccuaggcuucacgguacaagcguaa

SEQ ID NO: 2408 - RNA, 2031 nt, Artificial Sequence
  derived and/or modified CDS sequence (opt11) from DENV-4 Consensus__SSc-prME(F108S)
augagcacaaucacacuauugugccucaucccaacaguaauggcguuccaccuaaguaccagagacggugagccccucaugauagucgccaagcacgagagaggcagaccacuacuguucaaaaccacugagggaauaaacaaaugcacacucaucgccauggaccuaggcgagaugugcgaggacaccguaaccuacaaaugcccacuccuagucaacacggaaccagaagacauagacugcuggugcaaccucaccagcacaugggucauguacggcacaugcacacagagcggggaacgaagaagggagaagagauccgucgcgcuaaccccacacagcggcauggggcuggaaacaagagcagagacguggaugagcagugaaggggccuggaagcaugcacaaagaguagaaagcuggauacuccgaaacccaggauucgcacugcuagcaggauucauggcauacaugaucggacaaacggggauucagcgaacaguauucuucgugcugaugaugcucgucgccccgagcuacggcaugcgauguguaggcgucggaaaccgcgacuucguggaaggaguaagcggaggggcauggguagaccucguccuggagcacggaggaugcgucaccacaauggcacagggaaagccaacucucgacuucgagcugacgaaaacaacagccaaagaagucgcacuucuccgcacauacugcaucgaagcaagcauauccaacauaacaaccgcaaccagaugcccgacacaaggagaacccuaccuaaaagaagaacaagaccaacaauauauaugccgaagagacguaguggaccgcggauggggcaacgggugcgggcuaucaggaaaaggaggcgucguaacgugcgcaaaauucagcugcaguggaaaaauaacgggcaaccuggugcaaauagaaaaccuagaauacacggucguagugaccguccacaacggagacacccacgcagucggcaacgacacauccaaccacggagucacagcuaccaucacacccaggagcccgucaguggagguaaaacucccagacuauggagaacucacccuagacugcgaaccacgaagcggaauagacuucaacgaaaugauacuaaugaaaaugaaaaagaaaacauggcuagugcacaaacagugguuccuagaccucccacugccguggaccgcaggagcggacacaagcgaagugcacuggaacuacaaagaacgaauggucacauucaaaguaccccacgcaaaacgacaagacguaacagugcucgggagccaagaaggcgccaugcauuccgcacucgcaggggcaaccgaaguagacagcggagacggaaaccacauguucgcgggccaccucaaaugcaaaguccgaauggaaaaacuacggaucaaaggaaugagcuacacgaugugcagcggcaaguucucaaucgacaaagaaauggcagaaacucagcacgggacaaccguaguaaagguuaaauacgagggagccggagcaccaugcaaagucccaauagaaauccgagacgucaacaaggaaaaaguagucgggcgaguaauaagcaguacaccgcuagcagagaacacaaacucagucaccaacauagaacuagaacccccauucggggacucauacauaguaauaggaguugguaacagugcacucacacuacacugguucaggaaagggaguagcaucggcaaaauguucgaaucaacauacagaggcgcaaaacgcauggcaauucugggcgagacggcgugggacuucggcagcguaggaggacucuucacaucccuaggaaaagcgguacaccaggucuucgggucagucuacaccacgauguucggaggaguaagcuggaugauaaggauacuaauaggcuuccuaguacuguggaucgggacaaacagcagaaauaccucaauggcaaugacaugcauagcggucggagggauaacccuauuccucggauucacaguacaagccuag

SEQ ID NO: 2409 - RNA, 2031 nt, Artificial Sequence
  derived and/or modified CDS sequence (opt11) from DENV-4 Consensus__SSc-prMEdelstem_TM-JEV
augucaaccauaacccuccuaugucucaucccgacaguaauggcauuccaccuaagcacacgcgacggcgaaccccucaugaucgucgcaaaacacgaaagaggaagaccccugcuguucaaaacgacagaaggaaucaacaaaugcacacucauagccauggaccuaggcgaaaugugcgaggacacagugacauacaagugcccccugcuagucaacacagaaccggaagacaucgacugcuggugcaaccuaacaagcaccugggucauguauggcacuugcacacaaucaggcgagcggcgccgcgaaaagagaagugucgcccucacaccccacucaggaaugggacuugaaacccgcgcggagaccuggaugagcucggaaggcgcauggaaacaugcccagcgcguagaaagcuggauacuccgaaaccccggguucgcccuccuggcaggcuucauggcauacaugauaggacagacgggaauacagcgaacggucuucuucguccugaugaugcuaguagccccauccuacggaaugcgaugcguaggcgugggaaacagagacuucgucgaaggcguaagcggcggcgcaugggucgaucuaguacucgagcacggcggcugcguaaccacaauggcccaaggaaagccgacccuagacuucgaacuaacgaagaccacagccaaagaaguagcccuacucagaacauacugcauagaagcgagcaucucaaacauaaccaccgcaacaagaugcccaacacaaggagaacccuaccucaaagaagaacaagaccaacaguacaucugccgacgagacguagucgacagaggauggggaaacggcugcggccuauucggaaaaggcggcgucgucacaugcgcaaaauucagcugcagcggaaaaauaacaggcaaccuaguccaaauagagaaucuggaauacaccgucgucguaaccguacacaacggagacacacacgccguaggaaacgacacaagcaaccacggagucaccgcaacgaucacaccacgcagccccagcgucgaaguaaaacugccggacuacggcgaacucacccuagauugcgaaccaagaagcggcauagacuucaacgaaaugauacuaaugaaaaugaaaaagaaaacauggcugguacacaaacaaugguuucuagaccucccccucccauggacggccggggcagacacaucggaagugcacuggaacuacaaagaacgcauggugacauucaaaguuccacacgcgaaacgacaagacgucaccguacucggaagccaagaaggcgcgaugcacagcgcacucgccggcgcaaccgaagucgacagcggagacggaaaccacauguucgcaggacaccuaaaaugcaagguacgcauggagaagcucagaaucaaaggaaugagcuacacgauguguucaggcaaauucagcauagacaaagaaauggcagaaacucaacacggaacaacgguagucaaaguaaaauacgaaggagcaggagccccauguaaagucccaauagaaauccgcgacguaaacaaagagaaaguaguaggacgagucauaagcagcacaccccuggccgagaauaccaacucggucaccaacaucgaacuagaaccaccauucggcgacagcuacauaguaauaggaguaggaaacucggcgcuaacacuacacugguuccgaaaaggcagcacacucggaaaggcauucagcaccacccucaagggcgcccaaaggcuagcagcccucggggacacagcaugggacuucgggagcauaggcggagucuucaacagcaucggcagagcgguccaccaagucuucggaggagcauucagaacccucuucggaggaaugagcuggauaacccagggacuaaugggagcgcuacugcuauggaugggaguaaacgcaagagaccgcuccauugccuuagcguuccucgcaaccggcggcguccuaguauuccucgcgacgaacguacacgcauga

SEQ ID NO: 2410 - RNA, 1332 nt, Artificial Sequence
  derived and/or modified CDS sequence (opt11) from DENV-4 Consensus__SSm-EdelTM
augauacaaagaacgguauucuucguacuaaugaugcugguagcgccaagcuacggcaugagaugcguaggagucgggaaccgcgacuucguagaaggggucagcggcggggccugggucgaccuagugcuagaacacgggggaugcguaaccacaauggcgcaaggaaaacccacccuagacuucgagcuaacgaagacgacagcgaaagaagucgcgcuacugcgcacauacugcaucgaagcaagcauaucgaacauuacgacagccacacgcugcccaacacaaggggaaccguaccuaaaagaagaacaggaccaacaauacaucugcaggcgagacguaguggaccgaggcuggggaaacgggugcggacuauucggcaaaggcggagucgugaccugcgccaaauucucaugcucgggcaaaaucacaggaaaccucguacaaauagaaaaccuagaguacacaguagugguaacgguacacaacggcgacacgcaugcagugggaaacgacacaagcaaccacggcgugaccgcgacaauaacaccacgaucacccagcguagaagugaagcuaccggacuacggagagcucacacucgacugcgaacccagaagcgggauagacuucaacgaaaugauacugaugaaaaugaagaagaaaaccuggcucgugcacaaacaaugguuccucgaccuaccacuaccuuggacagcgggcgcggacacaagcgagguccacuggaacuacaaagagagaauggucacauucaaaguaccacacgcaaaaagacaggacguaacaguacuaggcagccaagaaggggccaugcacucggcgcuggcaggagcaacggaagucgacagcggcgacggaaaccacauguucgcaggccaucuaaaaugcaaaguaagaauggaaaaacugagaaucaaaggaaugagcuacacaaugugcaguggaaaauucagcauagacaaagaaauggcagaaacgcagcacgggacaacagugguaaaaguaaaguaugaaggagccggcgcaccgugcaaagucccaauagaaauaagagacguaaacaaagagaaaguagucggaagagucauaagcuccacaccgcuggcagaaaacacaaacagcguaacaaacauagagcuagaaccaccauucggagacagcuacauagugauaggcgugggaaacucagcacucacgcuccacugguucagaaaaggaagcagcauaggaaagauguucgagagcacauacagaggagccaagcgaauggcaauccucggagaaacggcaugggacuucggcagcuga

SEQ ID NO: 2411 - RNA, 2376 nt, Artificial Sequence
  derived and/or modified CDS sequence (opt11) from DENV-4 Consensus__C-P2A-SSc-prME
augaaccaacgaaagaaaguagugcgaccacccuucaacaugcuaaagagagaacguaacaggguauccacaccacagggacuggucaaaagauucagcaccggacucuucagcggaaaagggccacuaagaaugguacucgcauuuaucacauuccuccgcguccugucaauaccaccgacagcaggcauccuaaagcggugggggcagcugaagaaaaacaaagcaauaaaaauacuaaucggauucagaaaagaaauaggacgaaugcucaacauucucaacggacgaaagcgcaacuucgaccugcuaaaacucgcgggggacguggagagcaaccccggaccaucaaccauaacacuccuaugcuuaauuccaacagugauggccuuccaccuaagcacacgcgacggagaaccccuaaugauuguagcaaaacacgagagaggcagaccccuacucuucaagacaacagaaggcaucaacaagugcacccuaauagccauggaccuaggugaaaugugcgaagacacaguaaccuauaaaugcccacugcuaguaaauacagaaccagaagacauagacugcuggugcaaccucacaagcacaugggucauguacggcacgugcacucaaagcggcgaacgccgacgagaaaaacgaucuguggcacucaccccgcacuccggcaugggacucgagacaagagcggaaacauggaugagcagugaaggggcauggaaacacgcccagagagucgaaucguggauacugcgaaacccaggauucgcacugcuagcaggauuuauggccuacaugauaggacaaacaggaauacagagaacaguauucuucguccugaugaugcuagucgcaccaagcuacggaaugcgaugcguggggguaggaaacagagacuucguagaaggagucuccggcggugcauggguagaccuuguccuagaacacggaggaugcguaaccacaauggcgcaaggaaaacccacacucgacuucgaacuaacgaagaccacagccaaagaaguggcacuacucagaacauacugcaucgaagcaucgaucuccaacauaacaaccgcaaccaggugccccacccaaggcgaacccuaccugaaggaggaacaagaccaacaauacauaugcaggcgagacgucguagaccgaggcuggggcaacgggugcggacuauucggcaaaggcggaguagucacaugcgccaaauucuccugcagcggcaaaaucacgggaaaccucguccaaaucgaaaaucucgaauacacuguagucguaacaguccacaacggcgauacccacgccguaggcaacgacacaagcaaccacggaguaacagcgaccaucaccccaaggagcccauccguggaaguuaaacuacccgauuacggggaacucacacucgacugcgaaccacgcucaggaauagacuuuaacgaaaugauacuaaugaagaugaaaaagaaaacauggcuaguacacaaacaaugguuccuagacuugccgcucccauggaccgcaggagccgacaccagcgaagugcacuggaacuacaaagaacgcaugguaacuuucaaagugccacaugccaaacgccaagacguaacagugcucggcagccaggagggagcaaugcacagugcacuagcaggggcaaccgaagucgacucgggagauggaaaccacauguucgcgggccaccucaaaugcaaaguaagaauggaaaagcuccggaucaaggggaugagcuacaccaugugcucaggcaaguucagcaucgacaaagaaauggcagaaacccaacacggcaccaccgugguaaagguaaaauacgaaggcgcaggagcacccugcaaaguccccaucgaaaucagagacgugaacaaagagaaagucguagggagaguaaucuccucaacgccccuggcagaaaacaccaauucggugaccaacauagagcuggagcccccauucggcgacuccuacaucgucaucgggguaggaaacagcgcgcuaacccugcauugguuccgaaaaggcagcagcaucggaaaaauguucgaaagcaccuaccgaggcgcaaagcggauggcuauccuaggagaaacagcgugggacuucggcagcguaggcggccuguuuacaucgcuaggaaaggccguacaccaggucuucggcuccguauacacgacaauguucggcggcguaagcuggaugauacgcauccuaaucggcuuucuaguccuauggaucgggacgaacagccgcaacacaagcauggccaugacgugcaucgcagucggaggcaucacacucuuccucggauucaccguacaagccuaa

SEQ ID NO: 2412 - RNA, 2043 nt, Artificial Sequence
  derived and/or modified CDS sequence (opt11) from DENV-4 Consensus__SSopt-prME(F108S)
augaaacgcaagaaaucaacaauaacacuacucugccucauaccaacaguaauggcguuccaccucuccacccgagacggcgagccccucaugauaguagccaaacacgagcgcggaaggccccuccuguucaaaacaaccgagggcaucaacaaaugcacacuaaucgccauggaccuaggagagaugugcgaagacaccgucacuuacaaaugcccccucuuagugaacacagaacccgaagacaucgacuguuggugcaacuuaacaucgacauggguuauguacgggacaugcacccaaagcggugaacgaagaagggaaaaacgaagcgucgcacuaacuccccacagcggcauggggcucgaaacacgagcagaaaccuggaugagcuccgaaggcgcauggaagcacgcccaaagaguggaaagcuggauccugagaaacccaggauucgcccuccucgcaggauucauggccuacaugaucggacaaacugggauacagcgcacaguauucuucguacuuaugaugcuagucgcacccagcuacggcaugcggugcguaggcgucgggaacagagacuucguggaaggcguauccggaggggccuggguggaccuaguccuagagcacggaggaugcguaacaaccauggcccaagggaagccaacccucgauuucgagcuaaccaaaaccaccgccaaagaagucgcacuucugcgaacauacugcauagaagcaagcauaagcaacaucacaacagcgacacgaugcccaacgcaaggggagcccuacuuaaaagaagaacaagaccaacaauacauaugcagaagggacgugguagaccgcggauggggaaacggcuguggacuaagcggaaaaggcggagugguaaccugcgcaaaauuuuccugcuccggcaaaaucacgggcaaccucguccagauagaaaaccucgaauacacaguaguaguaacaguccacaacggagauacccacgcggucggaaacgacaccagcaaccacggagucacagccaccauaacaccaagaucgccauccguggaaguaaagcuaccagacuacggcgagcuaacgcuggacugcgagccaaggucaggaaucgacuucaacgaaaugauccugaugaaaaugaaaaagaaaaccuggcuaguccacaaacaaugguuccuagacuuaccacuaccauggacagcuggagccgacacgagcgaagugcacuggaacuacaaagaacgaauggucaccuucaaaguaccacacgcaaaacgacaagacguuaccgugcuaggcagccaagaaggggcuaugcacagcgcacuagcaggagcaacagagguagacagcggagacggcaaccacauguucgcggggcaccucaagugcaaaguaagaauggagaaacuacgaaucaaagggaugucguacacaaugugcucaggaaaauucucaaucgacaaagagauggcagaaacucagcacgguacaacgguaguaaaagucaaguacgaaggagccggggcaccaugcaaagucccgaucgaaauacgcgacgugaacaaagagaaagucgucggacgaguaauaagcuccacucccuuagcagaaaacaccaacucaguaacaaacauagaacuagaaccacccuucggggacagcuacaucgugaucggagucggaaacagcgcccugacccuacacugguucaggaaaggcagcagcauaggaaaaauguuugaaagcacauacagaggagcaaaaagaauggcaauacuaggggagacagcaugggacuucggcucggugggcggacuguucacaagccucggcaaggcaguccaccaaguauucggcucaguauacacaacaauguucggaggaguaucauggaugauaagaauacuaaucggcuuccucguccucuggauagggaccaacagccgaaacacaagcauggcaaugaccugcauagcaguaggcggaaucacccucuuccugggguucacgguacaagccuaa

SEQ ID NO: 2413 - RNA, 2043 nt, Artificial Sequence
  derived and/or modified CDS sequence (opt11) from DENV-4 Consensus__SSopt-prME(V96H)
augaagcgcaagaaaucgacaauaacccugcuaugccucaucccgacgguaauggcauuccaccuaagcacacgagauggggagccccucaugaucgucgcgaaacacgaacgggggaggccccuauuauucaaaacaacagagggcauaaacaaaugcacgcucaucgcaauggaccuaggagaaaugugcgaggacaccgugacauacaaaugcccauuacucguaaacacagaaccagaagacaucgacugcugguguaaccugacaagcacguggguaauguauggaacgugcacacagucaggggagagaagacgagaaaaacgaagcguagcccucaccccgcacucaggaaugggacucgaaacaagagcggaaaccuggauguccagcgagggggccuggaaacacgcccagcgggucgaaucauggauacuacgaaacccaggcuucgcguugcuggcaggcuucauggcauacaugauagggcaaacaggcauacaacgaaccguguucuucguacugaugaugcuaguagccccgagcuacggcaugcgcugcgucggggucgggaacagggacuucgucgagggcgucagcggaggagcguggguggacuugguacuagaacacggagggugcguaaccacgauggcgcaagggaaaccaacccuagacuucgaacugacgaaaacgaccgccaaggaagucgccuuacucagaacauauugcauagaagcgagcaucagcaacauaacaacggcgaccaggugcccgacacagggcgaacccuaucucaaagaggaacaagaucaacaguacauaugccggcgagaccacguggacagaggcuggggaaacggaugcggacuauucggaaaaggagggguagugacgugcgcaaaauucagcugcagcggaaaaauaacuggcaaccugguccagauagaaaaccuagaauacaccguaguaguaacagugcacaauggcgacacccacgccguaggaaacgacacaagcaaccacggagucacagccacgaucacccccaggagcccaagcguggaaguaaaauuaccagacuacggagaacugacacuggacugcgaaccacgcagcgggauagacuucaacgaaaugauacucaugaaaaugaaaaagaaaacauggcuaguccacaaacaaugguuccucgaccuaccccucccguggaccgcaggcgccgacaccagcgaagugcacuggaacuacaaagagcggaugguuacauucaaagucccacacgcaaaaaggcaggacguaacgguacuagggucgcaagagggcgcaaugcacagcgcccuggcgggagcaacagagguagacagcggagacgggaaccacauguuugcgggacaccuaaaaugcaaaguacgcauggaaaaacucagaauaaaaggcaugagcuacaccaugugcagcggaaaguucagcaucgacaaagagauggcggaaacgcagcaugguacaacagucguaaaagugaaauacgaaggagcgggcgcgccuugcaaaguaccgauagaaauccgcgacgucaacaaagagaaggugguagggagaguaauaagcagcacaccccuggccgaaaacacaaacagcgucacaaacauagaacucgagccaccauucggcgacuccuacaucguaaucggagucggaaacagcgcacugacccuacacugguucaggaagggcagcucaauaggaaaaauguucgaaagcaccuacaggggcgcaaaacgcauggccauacuuggcgaaacagcgugggauuucggaagcguaggaggacucuucacaagccuagggaaagcagugcaucaaguguucggaagcguauacacaacgauguucggagggguuagcuggaugauacgcauacucauaggguuccugguauuauggauaggcacgaacagcagaaacacgagcauggccaugacaugcaucgcagucggcgggauaacgcuguuccuaggguucaccgugcaagcguaa

SEQ ID NO: 2414 - RNA, 2043 nt, Artificial Sequence
  derived and/or modified CDS sequence (opt11) from DENV-4 Consensus__SSopt-prME(E186F)
augaagagaaagaaaagcacaauaacccuccucugccucauaccaacggugauggcguuccaucuaucgacccgagacggcgaaccucuaaugauaguagcgaagcacgagagaggaagaccacuacucuucaaaacaaccgaaggaaucaacaaaugcacacugauagcaauggacuugggggaaaugugcgaagauaccgucacauacaaaugcccacugcuaguaaacacagaaccagaggacaucgacugcuggugcaaccucaccagcacgugggucauguacggaacaugcacacaaucgggcgagcgacgaagagagaaaagaagcgucgcacugaccccacacagcggaaugggauuagaaacaagagcggagacauggaugucaagcgaaggcgccuggaagcacgcacaacgaguagaaagcuggauauuaagaaacccaggcuucgcccuacuagcaggauucauggcguacaugaucggacaaacaggcauacaaaggaccguguucuucguccugaugaugcugguagcaccgucguauggcaugagaugcgucggaguagggaaccgggacuuuguagagggcguaagcggcggagcauggguagaccuagugcuagaacacggagguuguguaaccaccauggcccaagggaagccaacauuggacuucgaacugaccaaaacaacagccaaagaaguugcccuacucagaacauacugcaucgaggcaagcauaagcaacaucacaacagccacccgaugcccaacccaaggagaaccauaccugaaagaagaacaggaccaacaauacaucugcaggcgcgacgucguagacagagguuggggcaacggcugcgggcuguucgggaagggagggguagucacgugcgccaaguucagcugcagcgggaaaauaaccgggaaccugguacaaauagagaaccucgaguacacaguaguaguaaccguacacaacggcgacacccacgccgugggaaacgacacaagcaaccacggagucacggccacuauaacgccgagaagcccauccguagagguaaagcuaccagacuacggggagcucacacuggacugcuuuccgagaagcggaaucgacuucaacgaaaugauacugaugaagaugaaaaagaagaccuggcuggugcacaaacagugguuccuagaccucccacuccccuggacggccggagccgacacaagcgaaguucacuggaacuacaaggaacgcauggucacauucaaggugccgcacgccaaacggcaagacgucacaguccucggaucacaagaaggagcaaugcauagcgcccuggcaggagcgacggaaguggacagcggcgacgggaaccacauguuugccggacaccucaaaugcaaaguaaggauggaaaaacugagaaucaagggaaugagcuacaccaugugcagcggcaaauucagcauagauaaagaaauggcagaaacacagcacggaacaacaguggugaaagucaaauacgaaggcgccggcgcgccaugcaaaguaccgauagaaaucagagacguaaacaaagagaaaguaguaggaagagucauaucaagcacaccccuagcagagaacaccaacucaguaacgaacaucgaauuggaaccaccauucggagacagcuacaucguaaucggaguaggcaacagcgcccucacacugcacugguucagaaaaggaagcagcauaggaaaaauguucgaaagcacguacagaggggcgaagcgaauggcaaucuuaggcgagaccgcaugggacuucggaagcguaggagggcuauucaccagccucgggaaagcaguucaccaggucuucggcaguguuuacacgaccauguucggagguguaagcuggaugauacggauacuaauaggcuuccucgugcuauggaucggaaccaacagcagaaacacaagcauggcaaugacaugcauagcagugggaggaauaacacucuuccuaggauucacaguacaagcguaa

SEQ ID NO: 2415 - RNA, 2043 nt, Artificial Sequence
  derived and/or modified CDS sequence (opt11) from DENV-4 Consensus__SSopt-prME(R188L)
augaagcgcaagaaauccaccauaacacugcucugccucaucccaacggucauggcauuccaccuaagcaccagggacggcgagccacuaaugauagucgccaaacaugaaaggggaagaccauuacucuuuaaaacaacagaaggaaucaacaaaugcacccuaauagccauggaccugggggaaaugugcgaagacacagugacauacaaaugcccauugcuagugaauacagagccggaagacaucgacugcuggugcaaccucaccuccaccuggguaauguacggaaccugcacacaaucgggcgaacgccgacgcgagaaaagaagcguagcacuaacaccgcacucgggcaugggacuggaaacacgagcagaaacauggaugagcagcgagggagccuggaaacacgcacaacgaguggaaagcuggauacucagaaacccaggauucgcccuacucgcgggauucauggcguacaugauaggacaaaccggaauccaaagaacaguauucuucguacuaaugaugcuaguagcaccaagcuacggcaugcgcugcgucggggucggaaacagagauuucguagagggagugagcggaggcgccuggguagacuugguacuagagcacggagggugcguaaccacaauggcccagggaaaaccaacacuagacuucgaacucaccaaaaccacagcgaaagaagucgcccugcucagaaccuacugcaucgaagcaaguauaagcaacaucaccaccgcaaccagaugcccgacacagggcgaacccuaccucaaagaagaacaagaccagcaguacauaugcagacgcgacguaguagacaggggguggggaaaugguugcggccuauucggcaaaggaggcguggucacaugcgccaaauucagcugcagcggaaaaauaaccgggaaccugguacagaucgaaaaucuggaauacacagugguaguaaccguacacaauggcgacacgcacgccgugggcaacgacacaagcaaccacggggucacagccacaaucacccccagauccccuagcgucgaaguaaaacuaccggacuacggcgaacugacacucgacugcgaaccgcuaucaggcauagacuucaacgaaaugauacucaugaaaaugaaaaagaaaacaugguuaguacacaaacaaugguuccucgaccuaccccucccguggacagccggagccgacacaucagaaguacacuggaacuacaaagaaaggauggucaccuucaaagucccacacgcgaaacggcaagacguaacgguacucggcucacaagaaggcgcgaugcacagugcgcuugccggcgcgaccgaagucgacagcggcgaugggaaccacauguucgccggccacuuaaagugcaagguacgcauggaaaaacuccgaaucaaaggaaugagcuacacaaugugcagcgggaaauucagcauagauaaggaaauggcagaaacgcaacacgggacuaccgugguaaaagucaaguacgaaggcgcgggagcacccugcaagguacccauagagauccgcgacgugaacaaagagaaaguagucggccgagugaucuccaguacaccgcucgccgaaaacacgaacagcgugaccaacaucgaacuggagccgcccuucggcgacagcuacauaguaauaggggucgggaacuccgcccuaacccuccacugguucaggaaaggaagcucaaucggaaaaauguucgaauccacguacagaggagcaaaaagaauggccauacuaggcgagaccgcaugggacuuuggaagcgucggagggcuauucaccucgcugggcaaagccguccaccaagucuucggaagcguauacaccacaauguucggaggcguaaguuggaugauaagaaucuuaaucggcuuccucguguuauggauaggaaccaacagcaggaacacgucaauggccaugacaugcaucgcggucggcggaauaacccucuuccuaggcuucacggugcaagcguag

SEQ ID NO: 2416 - RNA, 2043 nt, Artificial Sequence
  derived and/or modified CDS sequence (opt11) from DENV-4 Consensus__SSopt-pr(D104A)MEdelstem_TM,(F108S)-JEV
augaaacgcaagaaaucaaccauaacauugcuaugccucaucccaacagucauggcuuuccaucucagcacgcgcgacggcgaaccacugaugaucgucgcaaaacacgagcgcggccggccccuacuguucaaaacgaccgagggcaucaacaaaugcacccuaauagccauggaccuaggggaaaugugcgaggacaccguaaccuacaaaugcccccugcuaguaaacacggaaccagaagauaucgacugcuggugcaaucuaacgaguacguggguaauguacggcacgugcacccaaucaggcgaacgccggcgcgcaaaacgaagcguagcccuaaccccacacucaggaauggggcuggagacacgcgccgaaacguggaugaguucagaaggggccuggaaacacgcacaacgaguagaaagcuggauccuuaggaacccaggcuucgcacuacucgcaggcuucauggcuuacaugauagggcagacgggaauacaaaggaccgucuucuucguccuaaugaugcugguagcaccauccuacggaaugagaugcgucggaguaggcaacagagacuuugucgagggcguaagcggaggcgcgugggucgaccuaguacucgagcauggaggaugcguaacaacgauggcacaaggcaaaccgacccuagacuucgaacugaccaaaaccaccgccaaggagguagcccuacucagaacauacugcauagaggccucaauaagcaacaucacaacagcaacccgaugcccgacccagggcgagccauaucuaaaagaggaacaagaccaacaauacauaugccgacgcgacguagucgaucgaggauggggcaacggcugcggucuaagcggaaaagguggcguggugacaugcgcgaaauucagcugcagcgggaaaaucacaggcaaccuaguccaaauagaaaacuuagaauacacaguagucguaaccguucacaacggagauacccacgccgugggcaacgacacaagcaaccacggagucaccgcgacgaucacaccgagaagcccaagcguggagguaaagcuaccagacuacggagaacuaacccuagacugcgagccacgaucgggcauagacuuuaacgaaaugauccugaugaaaaugaaaaagaagacauggcuggugcacaaacaaugguuccuagaccuaccacugccguggacggcaggagcggacaccucggagguccacuggaacuacaaagaacguaugguaacauucaaagucccgcacgcgaaaagacaagaugucacaguacugggaucgcaggagggagcaaugcacagcgcgcuugcaggcgcaaccgaagucgacagcggggacgggaaccacauguucgccggacaccucaagugcaaaguacgaauggaaaagcuccggauaaagggcaugagcuacacaaugugcucgggcaaauuuucaaucgacaaagagauggccgaaacacagcacggcacgacaguagucaagguaaaguacgaaggggcgggcgcgccaugcaaaguacccauagaaauacgcgauguaaacaaagaaaaagucgucggacgaguaauaucauccacuccccuagcagaaaacacaaacagcgugacgaacaucgaacuagagccgcccuucggcgacagcuacauagugaucggggucggaaacagcgcgcuaacacugcacugguucagaaagggaagcacccucggaaaagcauucucaaccacacucaagggcgcccaaagacucgcagcccuaggcgacaccgcgugggacuucggaagcaucggaggggucuuuaauucgaucgggagagcgguccaccaaguguucggcggcgcauucagaacacuauucggaggaaugagcuggauaacacaggggcucaugggcgcacuucugcuauggaugggaguaaacgcaagggaccgaagcauagcccuagccuuccuagccacagguggagugcuggucuuccuggccacgaacguacacgcauaa

SEQ ID NO: 2417 - RNA, 2043 nt, Artificial Sequence
  derived and/or modified CDS sequence (opt11) from DENV-4 Consensus__SSopt-prMEdelstem_TM,(H261N)-JEV
augaagcggaagaaaaguaccaucacccugcuaugccuaauacccacagugauggcauuccaucuaucgaccagagacggcgagccacuaaugauaguagcaaaacacgagcgcggacgcccacuccuguucaaaaccacagaggggaucaacaaaugcacccucaucgcaauggaccuaggggagaugugcgaagacacaguaacguacaaaugcccccuucuaguaaacaccgaacccgaagacaucgacugcugguguaaccugacaagcacaugggucauguacgggacaugcacacaaagcggcgaacgaagacgagagaaaagaagcgucgcccuaacgccccacagcgggaugggacucgaaacccgcgcagaaaccuggaugaguucagaaggcgcguggaaacacgcgcaaaggguagaaucauggauacuaagaaacccaggcuucgcccuacuagcaggauucauggcauauaugauagggcaaaccggaauccagcgcaccguauucuucguccucaugaugcuaguagcacccuccuacggcaugagaugcgugggcgucggaaacagagacuuuguggaaggagucucaggaggggccuggguagaccuaguccuagaacacggcggcugcguaacgaccauggcacaaggcaaacccacgcucgacuuugaacucaccaaaaccacagcaaaagaaguagcacucuuaaggacauacugcauagaagccagcaucucaaacaucacaacagcgacuagaugccccacgcaaggagaaccauaccuaaaagaagaacaagaccaacaauauauaugccgacgcgacguagucgaccgaggguggggaaacggauguggccuguucggaaaaggaggagucguaacaugcgcgaaauucucgugcuccggaaagaucacaggcaaccuaguccagauagaaaaccuagaguacacagucguaguaacaguacacaacggagacacacacgcaguaggaaacgacacaagcaaccacggcguaaccgcaacaaucacgccgagaucaccaucaguugagguaaaacucccggacuacggcgagcuaacacucgacugcgaaccgcgaagcgggaucgacuucaacgaaaugauccuaaugaaaaugaaaaagaaaacauggcugguccacaaacaaugguuccucgacuugccauuaccauggacagcaggagccgacaccagcgaaguacauuggaacuacaaagagcgaauggugacauucaaagugccacaugccaaaagacaagacguaacgguacucggaagccaagagggcgcaaugaacuccgcccucgcaggcgcaacagagguagacuccggcgacggaaaucacauguucgcaggacaccucaaaugcaaaguacgaauggaaaaacucagaaucaaaggcaugaguuacaccauguguagcggcaaguucagcauagacaaagaaauggcagaaacacagcacggcaccacgguagucaaggucaaauacgaaggcgcaggggcaccaugcaaaguccccauagaaauaagagacguaaacaaagaaaaaguaguaggacgcguaauaagcagcacaccccuggcagaaaacaccaacagcgugaccaacaucgaacuagaaccacccuucggagacagcuacauagucauaggagucggaaacagcgcccuaacacuacacugguuccgcaaaggcagcacgcuggguaaggcauucucaaccacccuaaaaggggcgcaacgacucgcagcacugggagacacagcaugggacuucggcagcauaggcgggguauucaacagcaucgggagagccguccaccaaguauucggaggagcauuccgcacccuauucggcggaaugagcuggauaacacagggacuaaugggagcacugcuacuauggaugggagugaaugcacgagaccgaucaauagcacuggccuuccucgccacaggaggcguccuaguuuuucuagcgaccaacgugcacgcauag

SEQ ID NO: 2418 - RNA, 2043 nt, Artificial Sequence
  derived and/or modified CDS sequence (opt11) from DENV-4 Consensus__SSopt-prMEdelstem_TM,(R188L,A267T)-JEV
augaaacgcaagaaaagcaccauaacgcuacuaugccuaaucccaaccguaauggcauuccaccuaagcacacgcgauggagaaccucucaugauaguagcuaaacacgaaagaggcaggccgcuacuguuuaaaacaacagagggcaucaacaaaugcacgcuaauagcaauggaccuaggagaaaugugcgaagacacaguuaccuacaaaugcccgcuccuaguaaacacggaacccgaagacauagauugcuggugcaaucuaacgagcacauggguaauguauggaaccugcacccaaaguggcgaacgaaggcgggagaaaagauccguggcacugacgccccauagcggaaugggacuagaaacccgggccgaaacguggaugagcagugaaggagcguggaaacacgcccagcgaguggagagcuggauucuacgaaacccgggauuugcacuacucgcgggcuucauggcauacaugaucggccaaacaggaauacaaagaacgguguucuucguacucaugaugcucguagcaccgagcuacggcaugcgcugcgucggggucggaaacagggacuucguggaaggaguaagcgggggagcauggguggaccucguacuggaacacggagggugcguaacaacuauggcacaaggcaaaccaacccuagacuucgaacuaacgaagacaacagcaaaggaggucgcccuacuacgaacauacugcaucgaagcgucaaucagcaauaucacaaccgcaacaaggugcccgacgcagggagaacccuacuuaaaggaggaacaagaccaacaauacaucugcagaagagacguuguugaccgcggcuggggaaaugggugcggccuauucggaaaagggggcguggucacaugcgcgaaauucaguugcagcgggaaaauaaccgggaaccugguacaaauagaaaaccuggaauacacaguaguagugaccgugcacaacggggacacacacgccguaggaaacgauacgagcaaccacggagucacggcgacaauaacacccagaagcccaagcgucgagguaaaacucccagacuacggagaacucacacuggacugcgagccacuaagcggcauagacuuuaacgagaugauccucaugaaaaugaagaagaaaacguggcugguacauaaacaaugguuccucgaccuaccacuaccguggaccgccggggcagauaccagcgaaguccacuggaacuacaaagaaagaauggucacauuuaaaguaccgcacgcgaaacgccaagacguaacaguccuagggagccaggaaggagcaaugcacucagcgcucgcuggcacaacagagguagacagcggcgacggcaaccacauguucgccggccacuuaaaaugcaagguacggauggagaagcuaaggauaaaaggcauguccuacacaaugugcagcggaaaguucuccaucgacaaagaaauggcagaaacgcaacacggaaccaccguagucaagguaaaguacgagggagcaggcgcacccugcaagguaccgauagaaauaagagaugucaacaaggagaaaguggucgggcgagugauaagcagcacgccccuggcagaaaacacaaacagcguaacgaacauagaacuagaaccgccauuuggagacagcuauaucguaaucggaguaggcaacagcgcgcugacacugcacugguucaggaaaggaagcacgcuaggaaaggcguucucgacgacccucaagggagcgcaaaggcucgcggcgcuaggugacaccgcaugggacuucgggagcauagggggagucuucaacagcaucggaagggcgguccaccaaguauucggaggcgccuuccgaacacuauucggaggcaugagcuggaucacgcaaggccucaugggcgcccuccuacucuggaugggcgucaacgccagggacagaagcauagcacuggcauuccuagcaacaggaggaguccuaguauuccuagccaccaacguacacgcauag

SEQ ID NO: 2419 - RNA, 300 nt, Artificial Sequence
  derived and/or modified CDS sequence (opt11) from DENV-3 Consensus__C
augaacaaucaaaggaaaaagaccgggaaaccgagcauaaacaugcucaagcgcgugcgcaaucgcgugagcacgggcucgcaauuggccaagcgcuuuagcaagggcuugcucaauggccagggcccgaugaagcucgugauggcguucauagccuuucucagguucuuggccauacccccgaccgcgggcgugcucgcgcgcuggggcacguucaagaaaucgggcgcgaucaaggucuugaaaggguucaagaaagagaucucgaacaugcucucgaucauaaacaagcgcaagaaa

SEQ ID NO: 2420 - RNA, 342 nt, Artificial Sequence
  derived and/or modified CDS sequence (opt11) from DENV-3 Consensus__C-SSc
augaacaaucaaaggaaaaagaccgggaaaccgagcauaaacaugcucaagcgcgugcgcaaucgcgugagcacgggcucgcaauuggccaagcgcuuuagcaagggcuugcucaauggccagggcccgaugaagcucgugauggcguucauagccuuucucagguucuuggccauacccccgaccgcgggcgugcucgcgcgcuggggcacguucaagaaaucgggcgcgaucaaggucuugaaaggguucaagaaagagaucucgaacaugcucucgaucauaaacaagcgcaagaaaacgagcuugugcuugaugaugaucuugcccgcggccuuggcc

SEQ ID NO: 2421 - RNA, 273 nt, Artificial Sequence
  derived and/or modified CDS sequence (opt11) from DENV-3 Consensus__pr
uuccaccucaccucccgcgacggcgaaccccgcaugaucgucggcaaaaacgaacgcggcaaaucccuccucuucaaaaccgccuccggcaucaacaugugcacccucaucgccauggaccucggcgaaaugugcgacgacaccgucaccuacaaaugcccccacaucaccgaagucgaacccgaagacaucgacugcuggugcaaccucaccuccaccugggucaccuacggcaccugcaaccaagccggcgaacaccgccgcgacaaacgc

SEQ ID NO: 2422 - RNA, 225 nt, Artificial Sequence
  derived and/or modified CDS sequence (opt11) from DENV-3 Consensus__M
agcguggccuuggccccgcacgugggcaugggcuuggacacgcgcacgcaaacguggaugagcgcggaaggggccuggcgccaggucgagaaaguggaaacgugggcgcucaggcacccgggcuuuaccauacucgcgcucuuucucgcgcacuauaucgggaccucgcucacgcaaaaggucgugaucuuuaucuugcucaugcucgugaccccgagcaugacc

SEQ ID NO: 2423 - RNA, 498 nt, Artificial Sequence
  derived and/or modified CDS sequence (opt11) from DENV-3 Consensus__prM
uuccaccucaccucacgcgacggcgaaccccgcaugaucgucggcaaaaacgaacgcggcaaaucccuccucuucaaaaccgccuccggcaucaacaugugcacccucaucgccauggaccucggcgaaaugugcgacgacaccgucaccuacaaaugcccccacaucaccgaagucgaacccgaagacaucgacugcuggugcaaccucaccuccaccugggucaccuacggaaccugcaaccaagccggcgaacaccgacgcgacaaacgcuccgucgcccucgcaccccacgucggcaugggccucgacacccgcacccaaaccuggaugucagccgaaggcgccuggcgccaagucgaaaaagucgaaacaugggcccuccgacaccccggcuucaccauccucgcccucuuccucgcccacuacaucggcaccucacucacccaaaaagucguaaucuucauccuacucaugcucgucacccccuccaugacc

SEQ ID NO: 2424 - RNA, 1479 nt, Artificial Sequence
  derived and/or modified CDS sequence (opt11) from DENV-3 Consensus__E
augagaugcgucggagucggcaacagagacuucguagaaggcuugucaggagccacauggguggacgucguccuagaacacggcgggugcguaacaacgauggccaaaaacaaaccaacccuggacaucgaacugcaaaagaccgaggcaacacaacuggcaacgcucaggaaacuaugcauagaagggaaaaucaccaacaucaccacagacagcagaugcccaacgcagggcgaagccacacuaccagaagaacaggaucaaaacuacguaugcaaacacacuuacguagacagagguuggggcaacggcugcggacucuucggaaaagggagccuagucacaugcgcaaaauuccaaugccucgaaccaaucgaaggaaaaguaguccaauacgaaaaccuaaaauacaccguaauaauaacagugcacacaggggaccaacaccaaguaggcaacgaaacgcaagggguaacggccgaaaucacaccacaagccucgaccacagaagcaauacuaccagaauacgggacccugggccuagaaugcagcccacggacaggccuagacuucaacgaaaugauacuacucaccaugaaaaacaaagcauggaugguccaccgccagugguucuucgaccucccacucccguggacgagcggagccacgaccgaaacaccaaccuggaaccguaaggagcuccuagucacauucaaaaacgcgcacgcgaaaaagcaagaggucguagugcucggcucacaagaaggcgcaaugcacacagcacuaacaggcgcgaccgaaauccaaaacagcggagggaccucaaucuucgcaggccaccugaaaugcagacugaagauggacaaacucgaacucaaaggcauguccuacgccaugugcacaaacacauucguacuaaagaaagaggucucagaaacacaacacggcacaauccucauaaaagucgaauacaaaggcgaagacguacccugcaagauacccuucagcacggaagacggacagggaaaagcccacaacggaagacugaucacagccaacccaguggucacaaagaaagaagaacccguaaacauagaagcagaacccccauucggcgaaagcaacaucguaaucgggaucggagacaacgcccucaaaauaaacugguacaagaaagggagcucaaucggaaaaauguucgaggccacagcccggggagcacgaaggauggcaauccuaggcgacacagccugggacuucggaagcgucggcggaguccugaacucacuagggaaaaugguccaccaaaucuuuggaagcgccuacacggcccucuucagcggaguaagcugggucaugaaaaucggaaucggcguacuccuaaccuggauaggccucaacagcaaaaacacgucaaugagcuucagcugcaucgcgaucggcaucaucacccuguacuuaggagcggucgugcaagcc

SEQ ID NO: 2425 - RNA, 1977 nt, Artificial Sequence
  derived and/or modified CDS sequence (opt11) from DENV-3 Consensus__prME
uuccaccugaccucgcgcgacggcgaacccagaaugauugucggcaaaaacgaaagaggaaagagcuuacuauuuaaaacggcaucaggaauaaacaugugcacgcuaaucgccauggaccucggcgagaugugcgacgacaccgugaccuacaaauguccccacaucaccgaaguggaacccgaagacaucgauugcuggugcaaccucacaagcacguggguaacguacggaacuugcaaucaagcaggcgaacacagacgcgacaaaaggagcgucgccuuagcuccccacgugggcaugggccuagacacacgaacccaaacauggaugagcgcggaaggagcauggcgacaaguagaaaaagucgaaaccugggcgcuuagacaccccggcuucaccauauuagcacuguuccucgcgcacuacaucgggaccucacugacgcaaaaagucgucauauuuauccuacuaaugcucguaacacccucaaugaccaugcgcugcgucgggguaggaaaccgggacuucgucgaaggauuaagcggggccacauggguggacguggucuuagaacauggcggcugcguaacaacgauggccaaaaacaaaccaacccuggacaucgaacuacagaaaaccgaggcaacacaacuagcgacgcucagaaaacuauguaucgaaggaaaaauaacgaacaucacgacagacagcagaugcccaacacaaggcgaggccacacucccggaagaacaagaccaaaacuacgugugcaaacacacguacgucgaccgaggcuggggaaacggcugcggccuguucgggaaaggaagucuagucaccugugcgaaauuccaaugccucgagccaauagaagggaaagucguccaguacgagaaccuaaaauacaccguaaucauaaccguacacacaggcgaccaacaccaagugggcaacgaaacacaagggguaacggccgagauaacaccccaagcaucaaccaccgaggcaauccuacccgaguacggaacgcucggccuggaaugcagcccgcgcacaggcuuggacuucaacgaaaugauacuccucacgaugaaaaauaaagcguggaugguacaccgccaaugguucuucgaccucccccuacccuggaccagcggagccacaaccgagaccccaaccuggaacaggaaagaacuccuaguuacguucaaaaacgcgcaugcgaaaaagcaagaagucgugguccuaggcucgcaagaaggagcaaugcacaccgcauuaacaggagcaacagaaauccaaaacagcggcgggaccaguaucuucgcgggacaccucaaaugccgccucaaaauggacaaacuagaacucaagggcaugucguacgcgaugugcacaaacacauucguacucaagaaagaaguaucggaaacgcaacauggcaccauccuaauaaaggucgaguacaaaggagaagacguacccugcaaaaucccauucagcacagaagauggccaaggcaaagcccacaacggccgccugauuacagcaaaccccgucguaacgaagaaagaggaacccguaaacauagaggcagaaccacccuucggagagagcaacaucgugaucggaaucggggacaacgcccuaaaaauaaauugguacaagaaaggguccucaaucggaaaaauguucgaagccacggccagaggcgcacgcaggauggcgauauuaggagauacagcgugggacuucgggagugucggaggcguccugaacagccucggaaaaaugguacaccaaauauucggcagcgcguacacagcccuguucucagguguaagcugggucaugaaaaucggcaucggaguccucuugacauggauuggacucaacagcaaaaacacgagcaugagcuucagcugcaucgccaucgggaucauaacccuguaccugggcgcgguagugcaagcc

SEQ ID NO: 2426 - RNA, 2019 nt, Artificial Sequence
  derived and/or modified CDS sequence (opt11) from DENV-3 Consensus__SSc-prME
acaagccucugccuaaugaugauccuaccggcagcccucgccuuccaccucacuucacgagacggugaaccaagaaugaucguaggcaaaaacgaacggggcaaaagccuccuauucaaaacagccuccggcauaaacaugugcacacuaaucgccauggaccuaggcgaaaugugcgacgacacaguuacauacaaaugcccccacauaacagaaguagagccagaagacauagacugcuggugcaaucuaacaagcacauggguaaccuacgguacaugcaaccaagccggcgagcaccgaagagacaaaagaagcgucgcacuagccccgcacgugggcaugggccuagacacacgaacgcaaacauggaugagcgcagaaggagcauggcgccaagucgaaaaagucgaaaccugggcacuuaggcaccccggauucaccauacucgcgcuauuccuagcgcacuacauaggaaccucacuaacacaaaaagucgugaucuucauccuacucaugcuagucacccccaguaugacaaugcgcugcguaggggugggaaacagagacuucgucgaaggccuaaguggagcaacaugggucgaugugguccuagagcacggcggaugcgucacaacaauggcgaaaaacaaaccgacccuggacauagaacuacagaaaacagaagcaacacagcuggccacccuccgaaaacuaugcaucgaaggaaagaucacaaacaucacaacggacagccgcugccccacgcagggagaagcaacacuaccggaagaacaagaccaaaacuacgucugcaagcacacauacgucgauagaggcuggggcaauggcugcggccuguucgguaagggcucacucgucacaugcgcaaaauuccaaugccuggaaccgaucgaaggaaaagugguccaguacgaaaaccucaaauacaccguaaucaucaccguacacacaggcgaccaacaccaaguggggaacgagacacaaggagucacugcugaaaucacaccucaagccucgacaaccgaagcaauccuaccagaauacggcacccugggccuggaaugcagcccacgaacaggcuuagacuucaacgagaugauacuucugaccaugaaaaacaaagcauggaugguccaccgacagugguucuucgaucucccguuaccauggacauccggagccacaacagagaccccgaccuggaacagaaaggagcuccucgucacguucaaaaacgcacacgccaagaaacaagaaguggugguccuaggaagucaagaaggagcgaugcacaccgcccucacaggcgccaccgaaauacagaacucaggaggaacgucuauauucgcaggacaccugaaaugccguuugaaaauggacaaacucgaacucaaaggcaugucauacgccaugugcaccaacacauuuguccucaagaaagaagucucagaaacacaacacggcaccauccuaauaaaagucgaauacaaaggagaagacguacccugcaaaauacccuucagcacagaagacggccaaggcaaagcccacaacggacgccugaucacagccaaccccguaguaacaaagaaagaagaaccagugaacauagaagcggaaccgcccuucggcgaaagcaacaucguaauuggaaucggagacaacgcccugaaaauaaacugguacaagaaaggaaguagcaucgggaaaauguucgaagcaacagcccgcggagcacgacgcauggcaaucuuaggcgacaccgccugggacuucggcagcgugggagguguacugaacucgcuaggcaaaaugguacaccaaauauucggcuccgccuacacagcccuauucagcggagucaguugggugaugaaaauaggcaucgggguacuccugaccuggauaggguuaaacagcaagaauacaagcauguccuucucaugcauagccauaggaaucaucacguuauaccugggagcagucguccaagca

SEQ ID NO: 2427 - RNA, 1056 nt, Artificial Sequence
  derived and/or modified CDS sequence (opt11) from DENV-3 Consensus__NS1
gacaugggcugugucauaaacuggaaagguaaagagcucaagugcgggagcgggauauucgugacaaacgagguacacaccuggaccgagcaauacaaauuucaagcggacucgccaaagcgccuggcaacggcaauagcaggagccugggagaacggcgugugcgggaucaggagcacgacccggauggagaaccugcucuggaaacaaauagcgaacgagcuaaacuacauacucugggaaaauaacauaaaacugacaguggucgugggcgacaucauaggagugcucgaacaggggaaaaggacccugaccccacaaccgauggagcucaaguacucguggaagaccuggggcaaggccaagauaguaacagcagaaacgcaaaacagcucguucauaauagacggcccgaacacgccagagugcccgucagugagcagagccuggaacgugugggaggucgaggacuauggcuuuggaguguucacgaccaacaucuggcuaaaacuaagggaaguauacacgcaacuaugcgaccacaggcucaugagcgcggccguaaaagacgagagggccguccacgcggacaugggcuacuggauagaaucgcagaaaaacgggaguuggaaacuggaaaaggccucgcucauagaagugaaaacgugcacguggccaaaaucgcacacgcucuggaguaacggcgugcuagagagcgacaugauaaucccaaaaucgcucgcgggcccgauaucacaacauaaccaccgaccgggcuaccacacgcaaacggccgggcccuggcaccugggcaaacucgagcuagacuucaacuacugugaagggacaacggucgugaucacggaaaacugcggaaccaggggcccgagccugcgaacgaccacggucucaggcaagcuaauacacgaguggugcugccggagcuguacacugcccccgcuaagguacaugggagaggacgggugcugguacgggauggagaucagacccauaagcgagaaagaggaaaacauggugaaaagccucgugagcgcg

SEQ ID NO: 2428 - RNA, 1857 nt, Artificial Sequence
  derived and/or modified CDS sequence (opt11) from DENV-3 Consensus__NS3
agcggcguacuuugggauguaccaagcccacccgaaacacaaaaagccgaacucgaagaaggagucuaccgaaucaaacagcaaggaaucuucggcaaaacccaaguaggcguaggcguacaaaaagaaggaguauuccacaccauguggcacguaacgcgaggcgccguacuaacguacaacggaaaacgccucgaaccgaacugggccagugucaagaaagaccuaauuagcuacggcggaggauggcgacuuagcgcacaauggcaaaaaggagaagaagugcaaguaaucgcagucgaacccgggaaaaacccgaaaaacuuccagacaaugccgggcacauuccagacaaccaccggagaaauaggcgcaauagcccucgacuucaaaccaggaacgagcggaucacccauaauaaaccgagaaggcaaaguaguaggacuuuacggaaacggcgucgugaccaagaacggaggauacgucagcggaaucgcccaaaccaacgcagaaccugacggcccgacaccagaacucgaagaagaaauguucaagaaaagaaaccucaccaucauggaccuacaccccgggagcggcaaaaccagaaaauaccuccccgcaaucguaagagaagcaauaaaaagacgccuccgaacacucauccuagcaccaacccgcguagucgcagcagagauggaagaggcacucaaaggccuacccaucagguaccaaacgacagcgacaaaaucagagcacaccggaagggagauaguagaccucaugugccacgccacguucacgaugagacuccuaaguccagucaggguaccgaacuacaacuuaaucaucauggacgaagcacacuucacagacccagcauccauagccgcaaggggauacaucagcacacgcguaggaaugggcgaagccgcagccaucuucaugaccgccaccccacccgggaccgcagacgcauucccacaaucaaacgcaccaauacaagacgaagaacgagacauacccgagcgaagcuggaacagcgggaacgaguggauaacugacuucgcagggaaaacaguuugguucguacccagcauaaaagccggaaacgauaucgccaacugccucagaaagaacggaaagaaagugauccaacuaagcagaaaaaccuucgauacagaauaccagaaaaccaaacuaaacgacugggacuucgucguaacgacagacauaagcgaaaugggagccaacuucaaagccgaccgagugauagaccccagacgcugccuaaaaccaguaauccugaccgacgggccagaaaggguaauacuagcgggcccaaugccaguaaccgcagcauccgccgcccaacgaagaggacgcgucggaagaaacccccagaaagaaaacgaccaauacaucuucaccggccaaccgcucaacaacgacgaagaccacgcccacuggacagaagccaaaaugcuacuggacaacaucaacacacccgaaggcauaauaccagcacucuucgaacccgaacgagagaaaagcgcagccaucgacggcgaauaucgacucaaaggagaaagcagaaaaacauucgucgaacucaugaggcgcggugaccuaccaguauggcuagcacacaaaguagccucagaaggcaucaaauacaccgaccgaaaauggugcuucgacggccaacggaacaaucaaauacuagaagaaaacauggacguagaaaucuggacaaaagaaggcgaaaagaagaaacuccgccccagguggcuagacgcccgcacauacucagacccacucgcacuaaaagaauuuaaagaguucgccgcaggacgcaaa

SEQ ID NO: 2429 - RNA, 2319 nt, Artificial Sequence
  derived and/or modified CDS sequence (opt11) from DENV-3 Consensus__C-prME
augaacaaucaaagaaagaaaaccgggaaaccaagcauaaacaugcucaaacgaguacgcaaccgagugagcacaggcucacaauuggcaaaacgguucuccaaaggauuacucaacggccaaggccccaugaaacucguaauggccuucauagccuuccuacgauuccuagccauacccccgaccgccggcguacuagcgagauggggcacguucaagaaaucgggggcgaucaaaguucucaaaggauucaagaaagagaucucaaacaugcucucgaucauuaacaaacgcaagaaaaccagcuugugccugaugaugauccuacccgccgcccucgccuuccaccucacaagccgagacggcgaacccagaaugauagucggcaaaaacgaaaggggaaaaagccuccuguuuaaaacagccucgggcauaaacaugugcacgcugauagccauggaucuaggggagaugugcgacgauacaguaaccuauaaaugcccccacauaacagaaguugaaccugaagacaucgacugcuggugcaaccuaacgagcacaugggucacauacggaacgugcaaccaagcaggcgaacaccggagggacaagcgcuccguggcacuagcgccgcacgugggcaugggccuggacacgcgcacgcaaacguggaugagcgcggaaggugccuggcgacaagucgagaaaguagaaaccugggcacuacgacacccaggcuucacgauucucgcgcuuuuucucgcacacuacaucggaacaucgcucacgcaaaaggucguaauauuuauccuccuuaugcuagucacaccaucaaugacaaugcgcugcguaggcgucggaaauagggauuucgucgaagguuuaagcggggccacuuggguagacguaguacuagaacacgguggaugcgucaccacaauggccaaaaacaaacccaccuuggacauagaacugcaaaagaccgaggcaacccaacuggccacucuucggaaacuaugcauagaaggcaagaucaccaacauaacaaccgacagcagaugccccacgcagggcgaagcaacacuacccgaagaacaagaccaaaacuacgucugcaagcacaccuacgucgauagaggauggggcaauggcugcggccuauucggaaaagggagcuugguaaccugcgcgaaauuccaaugccuagaaccgaucgaaggaaaagucguacaguacgaaaaccugaaauacaccgugaucauaaccguccacacgggugaccaacaccaaguaggcaacgagacacaaggagucacggccgaaaucacaccccaggcaucgaccacagaagcaaucuuaccugaauacgguacucuaggccuggaaugcuccccaagaacaggacucgacuuuaacgaaaugauccuccugaccaugaaaaauaaagccuggaugguccaccgccaaugguucuucgaccucccgcucccauggacaagcggagccacaacagagaccccgaccuggaacagaaaagaacuccuaguaacguucaaaaacgcacacgcuaagaaacaagaaguagucguacuaggcucacaagaaggggcgaugcacacugcacuaaccggcgcgaccgaaauacaaaauucagggggcacaucgaucuucgcaggacaccuaaaaugccgacugaaaauggacaaacucgaacuaaaaggcaugagcuaugcaaugugcaccaacacguucguccucaagaaagaggucucggaaacccaacacgguacgaucuuaaucaaaguagaguacaaaggagaagacgugccaugcaaaauacccuuuagcacggaagacggacaaggcaaagcucacaacggacgacugauaaccgcaaaccccgucguaacgaagaaagaggaacccgugaacauagaggccgaaccacccuucggagagagcaacaucgugauagggauaggagacaacgccuuaaaaauaaacugguacaagaaagggagcuccaucggaaaaauguucgaagcuaccgcuagaggagcgcgcagaauggcaauccugggcgacacggccugggauuucggcuccguggguggcguacuaaacucucucgggaaaaugguacaccaaauauucgggagcgcauacacagcacuguucuccggagugagcuggguaaugaaaauaggcauaggaguccuccucaccuggaucgggcucaacagcaagaauacaagcaugagcuuuuccugcaucgcgaucgggaucaucaccuuauaccucggcgcggucguccaagcg

SEQ ID NO: 2430 - RNA, 45 nt, Artificial Sequence; identical to SEQ ID NO: 1670
  derived and/or modified CDS sequence (opt11) from DENV-3 Consensus__SSc

SEQ ID NO: 2431 - RNA, 57 nt, Artificial Sequence
  derived and/or modified CDS sequence (opt11) from DENV-3 Consensus__SSopt
augaaacgcaaaaaaaccucccucugccucaugaugauccuccccgccgcccucgcc

SEQ ID NO: 2432 - RNA, 57 nt, Artificial Sequence
  derived and/or modified CDS sequence (opt11) from DENV-3 Consensus__SSm
augacccaaaaagucgucaucuucauccuccucaugcucgucacccccuccaugacc

SEQ ID NO: 2433 - RNA, 1482 nt, Artificial Sequence
  derived and/or modified CDS sequence (opt11) from DENV-3 Consensus__E
augcgaugcgucggcgucgggaacagggacuucgucgaaggacuaagcggagcaacguggguggacgugguccuagaacacggaggaugcguaaccacaauggcgaaaaacaaaccaacacuagacauagagcugcagaaaacagaggccacccaauuggcaacccuaaggaaacuaugcauagaaggaaaaauaaccaacauaacaaccgacagccgaugcccaacacaaggggaagcaacacucccggaggaacaagaccaaaacuacguaugcaagcacacguacguagacagaggcuggggcaacggcugcggccucuucggaaaaggcagccuagugacaugcgcgaaauuccaaugucucgaaccaauagaaggcaagguaguacaguacgaaaaccuaaaauauaccgugauaauaaccguucacacaggcgaccaacaccaaguaggcaacgaaacgcaaggggugacggccgaaauaacgccgcaagccucaacaacagaagccaucuuacccgaguacggaacccuaggccuggaaugcuccccacgcacgggccuggacuucaacgagaugauacugcugaccaugaaaaacaaagcguggaugguccaccgacagugguucuucgaccucccacuccccuggacgagcggcgccacaacagagacaccaaccuggaacaggaaagaacuacugguaacguucaaaaaugcgcacgcgaagaaacaagaggucguaguccuaggaucgcaagagggggcgaugcacaccgcgcucacaggcgccacagagauccagaacucgggcgggaccuccaucuucgcaggacaccugaaaugcaggcuaaaaauggacaaacuagagcucaaaggaauguccuacgccaugugcacaaacacguucgugcuaaagaaagaaguaucggaaacgcaacacggcaccauacugaucaaggucgaguacaaaggagaggacgugcccugcaaaauacccuucagcacagaagacggacaaggaaaagcccacaacgggagacuaauaacagccaacccgguagucacgaaaaaggaagaacccguaaacauagaagcggaaccgcccuucggagaaagcaacauaguaaucgggauaggagacaacgcccuaaaaauaaacugguacaagaaagggagcucaauaggaaaaauguucgaggccacagccaggggcgcacgaagaauggccauccugggcgacacagcgugggacuucggaagcguagggggcgugcuaaacucacucggaaaaaugguccaccaaauauuuggaagcgcguacacggcccuauucucgggaguaagcugggucaugaaaauaggaauaggcguacuacuaaccuggaucggacuaaacagcaagaacacaagcaugagcuuuagcugcauagcaauagggauaaucacccuauaucuaggggcagucguacaagcauaa

SEQ ID NO: 2434 - RNA, 1176 nt, Artificial Sequence
  derived and/or modified CDS sequence (opt11) from DENV-3 Consensus__EdelTM-variant (aa1-392)
augcgcugcgucggaguaggcaaccgcgacuucgucgagggccucagcggcgcaacaugggucgacgucguccuagagcacggcggaugcgugaccaccauggcaaaaaauaaaccgacccuagacauagaauuacaaaaaaccgaagcaacgcaacuagcaacccuaaggaaacuaugcaucgaaggcaaaaucaccaacaucacaaccgacucccgcuguccgacacaaggagaagccacgcucccagaagaacaagaccaaaacuacgucugcaaacacacauacguagaccggggcuggggaaacggcugcggccuauucggcaaaggaucccuagucacgugcgccaaauuccagugccuagaaccaauagaaggaaaagucguccaauacgaaaaccucaaauacacagucaucaucaccguccacacaggcgaccaacaccaaguaggaaacgaaacacaaggagucaccgccgaaaucacaccccaagccuccaccacggaagccauccuacccgaguacggaacccuaggccucgagugcucaccccgcaccggccuagacuucaacgaaaugauccuccucaccaugaaaaacaaagccuggaugguccaccgccaaugguuuuucgaccuaccacuacccuggaccagcggagccacaaccgaaaccccgaccuggaaccgcaaagaacuccucguaaccuucaaaaacgcgcacgcaaaaaaacaagaagucguaguccucggaucccaagaaggcgccaugcacacagcccuaaccggcgccaccgaaauccaaaacuccggcggcaccucaauauucgccggccaccucaaaugccgacuaaaaauggacaaacucgaacuaaaaggcaugagcuacgccaugugcaccaacacauucguccucaaaaaagaagucuccgaaacccaacacggcaccauccuaauaaaagucgaguacaagggcgaagacguaccaugcaaaauccccuucagcaccgaagacggccaaggcaaagcccacaacggccgacugaucacagccaacccagucgucacaaaaaaagaagaacccguaaacaucgaagcagaaccacccuucggcgaauccaacauaguaaucgggauaggcgacaacgcccucaaaaucaacugguacaagaaa

SEQ ID NO: 2435 - RNA, 1269 nt, Artificial Sequence
  derived and/or modified CDS sequence (opt11) from DENV-3 Consensus__EdelTM-variant (aa1-422)
augcgcugcguaggagucgggaacagagacuucgucgaaggccuaagcggagccacaugggucgacguaguacuagaacacggcgggugcguaaccacaauggccaaaaacaaacccacccucgacaucgaacugcagaaaaccgaagcaacacaacuggcaacacucaggaaacucugcauagaaggaaaaauaaccaacaucacaacagauagcagaugcccgacccaaggagaagcaacacuaccagaggaacaagaccaaaacuacguaugcaaacacacauauguagaccgaggauggggcaacggcugcggacuauucggaaaaggaagccuagucacgugcgcaaaauuccagugccucgaacccauagaagggaaaguaguccaauacgaaaaccucaaauacacaguaauaauaacaguacacaccggcgaccaacaccaaguaggcaacgaaacacaaggagucacagccgaaaucacgccccaagcgucaacaacagaagcaauccuaccagaguacggaacacucggccuagaaugcagcccacgaacaggacucgacuucaacgaaaugauacuccugaccaugaaaaacaaagccuggaugguacaccgccaaugguucuucgaccucccgcuaccauggaccagcggagccacaaccgaaacccccaccuggaaccgaaaagaacuacugguaacauucaaaaacgcgcacgcaaagaaacaagaaguaguaguccuaggcagccaggaaggcgcaaugcacaccgcacuaaccggagcaacagaaauacaaaacagcggcgggaccucaaucuucgcaggccaccugaaaugccgacugaaaauggacaaacucgaacuaaaaggaaugagcuaugccaugugcacaaacacguucguacucaagaaagaagucucagaaacccaacacggcacaauccuaaucaaagucgaguacaaaggagaagacgugcccugcaaaauaccauucagcacggaagacggccaaggaaaagcacacaacggucgccuaaucacggccaaccccgucgucaccaagaaagaggaacccguaaacaucgaagcagaaccacccuucggggagagcaacauaguaauagggaucggagacaacgcccucaaaauaaacugguacaagaaaggaagcucaaucgggaaaauguucgaagccacagcgagaggagcacgccgaauggccauccuaggcgacaccgcaugggacuucggauccuaa

SEQ ID NO: 2436 - RNA, 1260 nt, Artificial Sequence
  derived and/or modified CDS sequence (opt11) from DENV-3 Consensus__EdelTM-variant (aa1-419)
augcgcugcgucggcguaggaaacagagacuucgucgagggccucagcggagcaacauggguagacguaguacuagaacacggcggaugcgucaccacaauggccaaaaacaaacccacacuggacaucgaacuacagaaaaccgaagcaacacaacuagccacacucaggaaacucugcauagaagggaaaauaaccaacaucacaaccgacagcagaugccccacccaaggggaagccacacuaccagaagaacaagaccaaaacuacguauguaaacacacguacguagacagaggauggggcaacggcugcggucuauucggaaagggaagccuagucacaugcgccaaauuccaaugccuggaaccaauagaaggaaaaguaguccaauacgaaaaccuaaaguacaccguaauaauaacagugcacacaggcgaccaacaccaagugggaaacgagacucaaggagucacagcggaaaucacaccacaagccagcaccacagaagcgauccuacccgaauacgggacccucggacuagaaugcagcccacgcacgggccuagacuucaacgaaaugauacuccucaccaugaaaaacaaagcauggaugguccaccgccaaugguucuucgaccuaccacucccguggacgagcggagccacaaccgaaacaccaacauggaacaggaaagagcuauuaguaacauucaaaaacgcgcacgccaagaaacaggaagucguaguccuaggaucacaagaaggcgccaugcacacagcacuaacaggagcgacagaaauccaaaacucaggcggaaccucgaucuucgccggacaccuaaaaugcagacugaaaauggacaaacucgaacucaaaggaaugagcuacgcaaugugcacaaacacauucguacucaaaaaggaagucagcgaaacacaacacggaacaauucuaaucaaaguagaauacaaaggcgaagacguacccugcaaaauaccauucagcacggaagacggccaagggaaggcccacaacggaagacucaucacggccaaccccguggucacaaagaaagaggaaccagugaacaucgaagccgagccacccuucggagaaaguaacaucguaaucgggaucggagacaacgcccucaaaauaaacugguacaagaaagggagcagcauagggaaaauguuugaagcgacagccaggggcgcacgaagaauggcaauacucggcgacaccgcgugggacuga

SEQ ID NO: 2437 - RNA, 1155 nt, Artificial Sequence
  derived and/or modified CDS sequence (opt11) from DENV-3 Consensus__Edelaa101-107
augagaugcguaggcguaggaaaccgcgacuucguagaaggacuauccggcgcaacaugggucgacguaguacucgaacacggaggcugcgucacaaccauggccaaaaacaaacccacacucgacaucgaacuccagaaaacggaagcaacacaacucgcaacccuccgcaaacucugcaucgaaggaaaaaucaccaacaucacaacagacucccgcugccccacccaaggggaagccacccuaccagaagaacaagaccaaaacuacgucugcaaacacaccuacguagaccgaggcuucggaaaaggaagccuaguaaccugcgcaaaauuccaaugccucgaacccaucgaaggaaaagucguccaauacgagaaccucaaauacaccgucaucauaaccguccacacaggcgaccaacaccaagucggcaacgaaacacaaggagucacagccgaaaucacaccccaagccucgaccacagaagccauacuccccgaguacggaacccucggccuagaaugcagcccgagaaccggacuugacuucaacgaaaugauacuacuaacaaugaaaaacaaagccuggaugguccaucgacaaugguucuucgaccucccgcucccauggaccagcggagccaccaccgaaaccccgaccuggaaccggaaagagcuccuaguaacauucaaaaacgcacacgcgaaaaagcaagagguaguuguacuaggcucgcaagaaggcgcaaugcacaccgcacucaccggcgccaccgagauacaaaacucaggcggaacaucgauauucgccggccaccuaaaaugccgccucaaaauggacaaacucgagcucaaaggcauguccuacgcaaugugcacaaacacauucguacucaagaaagaagucucagaaacacaacacggaacgauccuaauaaaggucgaguacaaaggcgaggacguacccugcaaaauaccauucagcaccgaagacggccagggcaaagcccacaacggacgacucauaacggccaaccccguagucacaaagaaagaggaacccgugaacaucgaagccgaaccacccuucggagaaagcaacaucgugaucggcaucggagacaacgcccuaaaaauaaacugguacaagaaa

SEQ ID NO: 2438 - RNA, 1173 nt, Artificial Sequence
  derived and/or modified CDS sequence (opt11) from DENV-3 Consensus__EdelTM-variant (aa1-391)
augcgaugcgucggagucggcaaccgggacuucgucgagggccuaagcggcgccacgugggucgacgucguccuagaacacggcggaugcgucaccacuauggccaaaaacaaaccgacgcuugacaucgaacuacagaaaacagaagcaacacaacuagcaacacuaagaaaacucugcauagaaggcaaaauaacaaacaucacgaccgacuccagaugccccacacaaggcgaagcaacgcucccggaagaacaagaccaaaacuacgucugcaaacacacauacguagacagaggauggggaaacggcugcggccuguucggaaaaggaagccuagucacaugcgcaaaauuccaaugccucgaacccauagaaggcaaaguaguccaauacgagaaccugaaauacaccgucaucauaaccgugcacacaggcgaccaacaccaaguaggcaacgaaacccaaggagucacggccgaaaucacaccccaagccucgaccacagaagcaauccuacccgaauacggaacucuaggacucgaaugcagcccccgaaccggccuagacuucaacgaaaugauacuccugaccaugaaaaacaaagccuggaugguccaccgacaaugguucuucgaccucccacuacccuggaccucaggcgccacaacagagacacccaccuggaaccgaaaagaacuccuagucacauucaagaacgcacacgcaaagaaacaagaagucguaguacuaggcucacaagaaggcgcaaugcauaccgcacuaaccggcgccacagaaauacaaaacuccggcggaaccuccaucuucgccggacaccucaaaugccgccuaaaaauggacaaacuggaacucaaaggcaugagcuacgccaugugcaccaacaccuuuguccucaagaaagaaguauccgaaacacaacacggcacaauacuaaucaaagucgaauacaaaggagaagacguacccugcaaaauacccuucagcacagaagacggacaaggcaaagcacauaacggccgccucauaacagccaaccccgucgucacaaagaaagaagaaccaguaaacaucgaagcagagccgcccuucggcgaaagcaacaucguaaucgggauaggcgacaacgcccugaaaauaaacugguacaaa

SEQ ID NO: 2439 - RNA, 2025 nt, Artificial Sequence
  derived and/or modified CDS sequence (opt11) from DENV-3 Consensus__SSc-prME
augaccucccucugccugaugaugauccucccagcagcauuagcauuccaccuaacaucccgcgacggcgaaccccggaugauagucggcaaaaacgaaagaggaaaaagccuacuauucaaaaccgccagcggcauaaauaugugcacgcucauagcgauggaccuaggcgaaaugugcgacgacaccgugacuuacaaaugcccacacaucaccgaaguggaacccgaagacauagauugcuggugcaaccuaacgagcacauggguaaccuacggcacaugcaaccaagccggagaacaccgacgagacaaacgaagcgucgcgcucgcaccacacgucggcauggggcuagacacacgaacccaaacauggaugucagcagaaggagcauggcgccaggucgaaaaagucgaaacaugggcucuacgccaccccggcuucaccauccucgcacucuuccuagcacauuacaucggaaccagccucacgcagaaagucguaauauucauacuacucaugcuagucacccccagcaugaccaugcgcugcgucggcgucggcaacagagacuucguagagggacuaagcggagccacguggguagacgucguccuggagcacggcggcugugucacaacaauggccaaaaacaagccaacccuggacauagaacugcagaaaacagaagcaacacaacucgcaacacuacgaaagcuaugcauagaaggaaaaauaaccaacauaacaaccgacagcagaugccccacccaaggagaagcaacccucccugaggaacaagaccagaacuacgugugcaaacauaccuacgucgacagaggcuggggaaacggcuguggccuguucggaaagggaucccuaguaaccugugcgaaauuccaaugccuggaaccaaucgaaggaaaaguaguacaauacgagaaccucaaauacaccgugaucaucacaguacacaccggcgaucagcaccaaguggguaacgagacacaaggcgucacagccgaaauaacaccccaggccucaaccacagaagcaauccuaccagaauacgggacccugggacuugaaugcucaccacgcacaggacuggacuucaacgaaaugauccugcuaacaaugaagaacaaggcauggaugguccaccgccagugguucuucgaccucccacuacccuggacguccggagccacaacagaaaccccaaccuggaacagaaaagaacuucuagucaccuucaaaaacgcacacgcaaagaaacaagaagucgugguacuaggcucacaagaaggagcaaugcacaccgcccucacaggagcaaccgaaauacaaaacagcggcgggaccagcaucuucgccggacaccugaaaugccgccuaaaaauggacaaacuagaacuaaaaggaaugucauacgccaugugcacaaacacauucgugcuaaagaaagaaguauccgagacucaacacggaacaauccugauaaaagucgaauacaaaggggaagacguacccuguaaaauacccuucagcacagaagacggccagggcaaagcacacaacggcagauuaaucacagccaaccccgucguaaccaagaaagaagaaccaguaaacauagaggcggaaccacccuucggagaauccaacaucgucauagggaucggggacaacgcccugaaaauaaacugguacaagaaaggaagcuccaucggcaaaauguucgaggccacggcacgaggcgcacgcagaauggccauccuaggggacaccgcgugggacuucggauccgucgggggaguccucaacucacucggaaaaauggugcaccaaauauucggaagcgcauauacggcacuauucucuggcgucagcuggguaaugaaaauuggcaucggcguccuacuaacauggauaggacuaaacagcaaaaacacaaguauguccuucagcugcaucgcuauaggaaucaucacgcucuaucuaggcgccguaguccaagcauaa

SEQ ID NO: 2440 - RNA, 2025 nt, Artificial Sequence
  derived and/or modified CDS sequence (opt11) from DENV-3 Consensus__SSc-prME(F108S)
augacgucccucugccugaugaugauccuaccagcagcacucgccuuccaccucaccucccgagacggcgaaccgagaaugauaguaggcaaaaaugaaaggggaaaaagucuacucuucaaaacggccucaggaaucaacaugugcacccucauugcaauggaccucggcgaaaugugcgacgacaccgugacauacaaaugcccccacaucacagaagucgaacccgaagauauagacuguuggugcaaccuaacaucuacaugggugacauacggcacaugcaaccaggccggagaacauagacgagacaaaagaagcgucgcucucgcgccccacgucggcaugggccucgacacucgcacacaaacauggauguccgccgaaggggccuggcgucagguggaaaaagucgaaacgugggcacuaaggcaccccggauucacaauacuagcacucuuccucgcgcacuacauaggaacuagccucacgcaaaaagucgugaucuucauccuucucaugcuaguaaccccauccaugacgaugcguugugucggaguaggaaacagggacuucgucgaaggacuguccggagcaacauggguagacgucguccucgagcacgguggaugcguaaccacaauggcgaaaaacaaacccacccuggacauagaacuacagaaaacagaagcaacgcaacuagccacccuccggaaacucugcauagaagggaaaauaacaaacauaacaaccgacagccgaugcccaacacaaggagaggccacacuccccgaggaacaagaucaaaacuauguaugcaaacacaccuacguagaccgcggcuggggcaaugguugcggacucuccggcaagggaagccucgucacgugcgcaaaauuccagugccuggagcccaucgaaggcaaagugguccaauacgaaaaccugaaauacacaguaauaauaaccguccacacaggggaucaacaucaagugggcaacgaaacgcaaggagucacagccgaaaucacaccacaagcgucaacaacggaagcaauccuccccgaauacggcacacugggccuagaaugcagcccgcgcacaggccucgacuuuaacgagaugauacugcucacaaugaaaaacaaagcauggaugguacaccgccaaugguucuucgaccucccacuaccauggacaagcggcgccaccaccgaaacaccaacauggaauagaaaagaacuucuagucaccuucaagaacgcccacgccaaaaagcaagaagucguaguccucggcucacaagaaggcgcaaugcacaccgcacucacaggagccaccgaaauccagaacucaggcggaacaucuaucuucgccgggcaccucaaaugccgccuaaaaauggacaaacuagaacugaaaggcaugagcuacgccaugugcaccaacacauucgugcucaagaaagaggugucugagacgcagcacggaacuauacuaauaaaagucgaauacaaaggcgaggacguucccugcaaaauaccauucagcacagaagacggccaaggcaaagcccacaacggucgccugaucacggccaaccccgucgucaccaagaaagaagaacccguaaacaucgaggccgaaccacccuucggcgaguccaauauaguaaucggaauaggggacaaugcacugaaaaucaacugguacaagaaaggaagcucaauuggaaaaauguucgaagccaccgccagaggagcucgccgcauggcaauacucggcgacacugcaugggacuucgggagcguaggcggggucuugaacucccucggaaaaaugguacaccaaauauucggcagcgcguacacggcacuauuuucaggcguaagcugggucaugaaaauaggaaucggaguacuacucacauggauagggcucaacagcaaaaacaccagcaugagcuucagcugcaucgccaucggaauaauaacccuauaccuaggcgcagucgugcaagcguga

SEQ ID NO: 2441 - RNA, 2025 nt, Artificial Sequence
  derived and/or modified CDS sequence (opt11) from DENV-3 Consensus__SSc-prME(R186L)
augaccagccuaugccugaugaugauacucccggcagcacuggcauuccaccugacaucccgcgacggcgagcccagaaugauaguaggcaaaaacgagcgcggaaaaucacuacuauucaaaaccgccucagggauaaacaugugcacacucauagccauggaccucggagaaaugugcgacgacaccguaacauacaaauguccccacauaaccgaaguagaacccgaagacaucgacugcuggugcaaccugaccagcacuugggucaccuacggcacgugcaaccaagccggcgaacacagacgggacaaacgcagcgucgcccuagccccacacgugggcaugggacuggacacccgaacacaaacguggaugucggcagaaggcgcauggcgccaggucgagaaagucgaaacaugggcacuccgccacccgggcuucaccauacucgcacucuuccucgcccacuacaucggcaccucccucacgcaaaaagucgugauauucauccuccuaaugcuaguaacaccaucaaugacgaugcgaugcgugggcguagggaacagggacuucguagagggccuaagcggagccaccugggucgacgucguccuagaacacggcgggugcgugaccaccauggcgaaaaacaaaccaacgcuagacaucgaacuacaaaagacagaagcaacccaacuggcaacgcuccgaaaauugugcauagaagggaagaucacaaacauaacaacagacucaaggugcccgacccagggcgaagcaacccuaccagaggaacaggaccagaauuacguaugcaaacacaccuacguggaccgcggcuggggcaacggaugcggccuguucggcaaaggaagccuagucacaugcgcgaaauuccaaugucuugagcccauagagggaaaggucguacaauacgagaaccugaaguauaccguaaucauaaccguucacaccggcgaucaacaccaagucggaaacgaaacacaaggcguaacagccgaaaucacaccccaagccagcaccaccgaagccauccuacccgaguacggcacacuaggccuugaaugcagcccgcucaccggacuggacuucaacgagaugauacuccugaccaugaaaaacaaggccuggaugguccaccgacagugguucuucgaccuaccccuacccuggaccagcggagcaacaacggagacgccaacuuggaaccgaaaagaacuacugguaacguucaaaaaugcccacgccaagaaacaagagguagugguacucggaucacaggaaggagcaaugcacacagcacucacaggcgcaacagagauccaaaacucaggaggaaccucaaucuucgcgggacaccucaaaugccgacuaaaaauggacaaacucgaacucaaaggaaugagcuacgcaaugugcaccaacacauucgugcugaagaaagagguaucagaaacgcaacacggcacaauuuugaucaaagucgaauacaaaggcgaagacgucccaugcaaaauaccauucuccacagaagacggacaaggcaaagcccacaacggucgacuaaucacugcaaacccuguaguaacgaagaaagaggaacccguaaacauagaggcggaaccucccuucggcgagagcaacauaguaauaggaaucggagacaacgccuugaaaauaaacugguacaagaaaggauccucgaucggcaaaauguucgaggccaccgcaagaggcgcaagacggauggcaauccuaggagauacagcaugggauuucggcagcgugggaggcguccucaacucgcucgggaaaaugguacaccaaaucuucggaagcgcuuacacagcccuauucucaggaguauccuggguaaugaaaauaggaauaggcguacuacuaacauggaucggccucaacagcaaaaacacgaguauguccuucagcugcaucgcaaucggcauaauaaccuuauaccugggcgcagucguccaagcauaa

SEQ ID NO: 2442 - RNA, 2025 nt, Artificial Sequence
  derived and/or modified CDS sequence (opt11) from DENV-3 Consensus__SSc-prME(A265T)
augaccagccucugccucaugaugauccuccccgcagcccuagccuuccaccucaccucgcgagacggagaaccccggaugauaguaggcaaaaacgaacgcggaaaaagucuucucuucaaaacggccucgggcauaaacaugugcacacucauagcaauggaucuuggagaaaugugcgacgacaccguaaccuacaaaugcccgcauaucacagaggucgaaccagaagacaucgacugcuggugcaaccuaacaagcacauggguaaccuauggaacuugcaaccaagcaggcgaacaccggcgagacaaacggagcguagcccuagcgccccacgucggaaugggccuggacacacgcacacaaaccuggaugagcgccgaaggagcauggcgccagguugagaaaguggaaaccugggcgcuccgccaccccggcuucaccauacucgcgcucuuucuugcacacuacaucggcaccagucuaacacaaaaaguagugaucuucauccuacucaugcucguaaccccgagcaugacuaugcgcugcgucggcgucggcaacagggacuucgucgagggcuugagcggagcaacauggguagacguaguacuagaacacggcgggugcgucacaacaauggccaaaaacaaaccaacccuggacaucgaacuacagaaaaccgaagcaacccaacuggccacacucagaaaauuaugcauagaagggaaaauaaccaacaucacgacagacagccgaugcccgacccaaggcgaagccacgcucccagaagaacaagaccaaaauuacguuuguaaacacacauacgucgacaggggauggggcaacggaugcggccuguucggaaaaggaagccugguuacaugcgcaaaauuccaaugccuagaacccauagaagggaaaguaguccaauacgagaaucuaaaauacacagucauaaucaccguacacacaggcgaccaacaccaaguaggcaacgaaacacaagggguuacggcagaaaucacaccccaagccucaacaacggaagcaauacugcccgaauacggaacccucggauuagaaugcagcccucguacaggccuagacuuuaacgaaaugauacuacuaaccaugaaaaacaaagcauggaugguccauagacaaugguucuucgaucucccacuaccguggacgagcggggccacaaccgaaaccccgaccuggaacaggaaagagcuauuagucacuuucaaaaacgcgcacgcaaagaaacaagaagucgugguacuagguucacaagagggcgcaaugcauaccgcacucacaggaaccacagaaauccaaaacucgggcgggacgucaauauuugccgggcacuugaaaugccgacucaaaauggacaaacucgaacucaaaggcauguccuacgcaaugugcacgaacacauucguacucaagaaagaagucagcgaaacgcagcacggcacgauacuaaucaaggucgaauacaaaggcgaagacguacccugcaaaauacccuucagcaccgaagacggccaaggcaaggcccacaacggccgccugauaacagccaaccccguggucacaaagaaagaggaaccaguaaacaucgaagcagaaccacccuucggcgaaagcaacaucgugauaggaauaggcgacaacgcacuaaaaauaaacugguacaagaaaggcagcucaaucggcaaaauguucgaagccacggcccggggagcacgccgcauggcaauccuaggcgacacggcgugggacuucgggagcgucggaggagugcucaacucgcucgggaaaaugguccaccaaaucuucggaagcgccuacacagcacuauucuccggaguguccugggucaugaaaauaggcauaggagugcuacuaaccuggauaggacuaaacagcaaaaacacaagcaugagcuucagcugcaucgcaauuggaauuaucacccucuaccuaggcgcagucguacaagccuaa

SEQ ID NO: 2443 - RNA, 2025 nt, Artificial Sequence
  derived and/or modified CDS sequence (opt11) from DENV-3 Consensus__SSc-prMEdelstem_TM-JEV
augaccagccugugccucaugaugauacuaccagcggcauuagcauuccaccucacaucacgcgacggagagccaagaaugauagucggcaaaaacgaaaggggaaaaucccuccuguuuaagaccgccuccggaaucaacaugugcacacucauagcaauggaccucggagaaaugugcgacgacacagucaccuacaaaugcccccacaucacggaagucgaaccagaagacaucgacugcuggugcaaucuaacaagcacguggguaaccuacggcacaugcaaccaagcaggcgaacacagacgcgacaagcgauccguggcccuggcaccccacgucgggaugggccuggacacccgaacccaaacauggauguccgccgaaggagccuggcgccaagucgaaaaaguagagaccugggcccuucgucaccccggcuucaccauacucgcgcuauuucuagcccacuauauaggcaccucccucacacaaaaaguagucaucuucauccuacuaaugcucguaaccccaagcaugacaaugcggugcgucggggucggcaacagagacuucgucgaaggacuuuccggcgccacauggguagacgugguacuagaacacggcggaugcguaaccacgauggccaaaaacaaaccaacccucgacauagaacugcagaaaaccgaagccacccaacuagccacccucaggaaacuaugcaucgaaggaaaaauaaccaacaucaccaccgacagcagaugcccgacccaaggcgaagcaacacucccggaagaacaagaccaaaacuacguaugcaaacacacauacgucgacagaggauggggaaacggaugcggccuguucggaaaagggagccuggucacaugcgcgaaauuccaaugccuagaacccaucgaagggaagguaguccaauacgaaaaccuaaaauacaccguuaucauaacaguacacacaggagaccaacaucaaguaggcaacgaaacgcaaggcguaacggccgaaauaacaccccaagcauccaccaccgaagccauccucccagaauacgguacacucggccuggaauguagcccccgcacaggccucgacuucaacgagaugauacuucugaccaugaaaaacaaagcauggaugguucaccgacagugguucuucgaccucccacucccauggacauccggagcaacgaccgagaccccaaccuggaacagaaaggagcuacucgucacauucaaaaacgcccacgccaaaaagcaagaggucgugguccuaggcucccaagaaggcgcuaugcacaccgcgcucacaggagcgacagagauacagaacucaggaggcaccucaauauucgccggacaccugaaaugccgccuaaaaauggacaaacucgagcucaagggcaugucuuacgccaugugcacuaacacauucguacugaagaaagaagucucagaaacacaacacggcacgauccugaucaaagucgaauacaaaggcgaggacguacccugcaaaauacccuucucaacagaagacggacaaggcaaagcccacaacggaagacuaaucacagccaaccccgucgucaccaagaaagaagaacccgucaacaucgaagccgaaccacccuucggcgagagcaacaucgucaucggcaucggcgacaacgcccucaaaaucaacugguacaagaaaggaaguacacuaggaaaggccuucucgacaacgcucaaaggugcgcaaagacuagcggcacuaggcgacaccgcaugggauuucggaagcauaggcggcgucuucaacuccaucggacgagccguccaccaaguauucggcggcgcauuccgaacccucuucggcgggaugaguuggauaacucaaggccucaugggcgcacuccuccucuggauggggguaaacgcaagggauaggagcauagcacuggccuuccucgcaaccgguggagugcuaguauucuuagcuacaaacgugcacgcauaa

SEQ ID NO: 2444 - RNA, 1326 nt, Artificial Sequence
  derived and/or modified CDS sequence (opt11) from DENV-3 Consensus__SSm-EdelTM
augacacagaaaguaguaauauucauacuacucaugcucgugaccccgagcaugacaaugagaugugucgggguaggaaacagggacuucguagaaggacuaagcggagccacauggguagacgugguacuggaacacggcggaugcguaaccacaauggccaaaaacaaaccaacccuggacauagaacuacaaaagacagaggcaacacaacucgcaacacuacgaaaacuaugcauagaaggaaaaauaaccaacaucacaacggacagcagaugcccaacccaaggagaagccacgcugccggaggaacaagaccaaaacuacguaugcaaacacacauacguagacaggggcuggggaaacggcugcggccuauucgggaaaggaagccuggucacaugcgcaaaauuccaaugccucgaacccauagaaggcaaagucguccaauacgaaaaccuuaaauacaccguaaucauaaccguacacacgggagaccaacaccaaguaggcaacgaaacacaagguguaacagccgaaaucacaccccaggcuuccacaacagaagcaaucuuacccgaauacggaacacuaggacuagaaugcagcccgcgcaccggacuagacuucaacgagaugauacuccuaacaaugaaaaacaaagcguggaugguccaccgccaaugguucuucgaccucccacuaccauggacaagcggggcgacaacagaaacccccacguggaacagaaaagaacuacucgucacauucaagaacgcacacgcgaagaaacaggaaguaguaguccuaggcucacaagagggcgcgaugcacaccgcccucacgggcgcaacagaaauccagaacucgggcggaacaucaaucuucgccggacaccugaaaugucgccuaaaaauggacaaacucgaacucaaaggcaugagcuacgcaaugugcacgaacacguucguccuuaagaaagaagugucggaaacccaacacggaacaaucuuaaucaaaguggaauacaaaggagaggacguacccuguaaaauacccuucagcacagaagacggccaggguaaagcccacaacgggcgacuaaucacagcaaaccccgugguaacgaagaaagaagaaccaguaaacaucgaagcagaaccacccuucggcgaaagcaacauagugaucggaauaggagacaacgcacugaaaauaaacugguacaagaaaggaagcucgauagggaaaauguucgaggcgacagccagaggagcacgacgaauggcaauccucggcgacaccgcgugggacuucggaagcuag

SEQ ID NO: 2445 - RNA, 2373 nt, Artificial Sequence
  derived and/or modified CDS sequence (opt11) from DENV-3 Consensus__C-P2A-SSc-prME
augaacaaccagcgcaagaaaacgggcaaacccucgauaaacaugcugaaacgaguacgcaaccgcgucucgacaggcagccaacuagcaaaacgauucucaaaaggacuccuaaacggccaaggcccaaugaaacucgucauggcauucaucgcguuccuacgcuuccuagcaauacccccaacagccggcguccuggcacgcuggggcaccuucaagaaaagcggggcaaucaaagugcuaaaaggcuucaagaaagaaaucagcaacaugcucagcaucaucaacaaacgaaagaaaaacuucgaccugcucaaacuagccggagacgucgaguccaaucccggccccacaagccugugccuuaugaugauccuacccgcagcccuagcauuccaccucacgagccgggauggcgaaccacgaaugauagucggcaaaaacgaacgaggaaaaagccuacucuucaaaacagcauccggaaucaacaugugcacacuaauagccauggaccucggagaaaugugugacgacaccguuacauacaagugcccacacaucacagaaguagagccggaagacaucgauugcuggugcaaccugaccagcacauggguaaccuacggaaccugcaaccaagcgggcgaacaccgacgcgacaaacggucggucgcccucgcgccucacguaggcaugggacuagacacaaggacgcagacauggaugucagcagaaggagccuggcgacaagucgaaaaaguagaaaccugggcacuccgccaccccggcuuuacaauacucgcacuauuccuagcacacuauauaggaaccagccucacgcaaaaggucgucaucuucaucuuacucaugcucgucacaccauccaugaccaugcgcugcgucggagugggcaaccgggacuucgucgagggacugagcggcgccacauggguagacgucguccuagaacacggaggcugcgugacaaccauggccaaaaacaaacccacauuagacaucgaacuacagaaaacagaagccacgcaacuagcaacacuaaggaaacuaugcauagaaggcaaaauaaccaacaucacgaccgacuccagaugccccacccaaggcgaagccacccucccugaagaacaagaucaaaacuacguaugcaaacacaccuacguagaccgggguuggggaaacggaugcggccucuucgggaaaggcucccuagucacaugcgccaaauuccaaugccuagaaccaaucgaaggaaagguaguacaauaugaaaaccugaaauacacgguaauuauaaccguccacaccggagaccaacaccagguaggcaacgaaacccaaggggucaccgccgaaaucacgccccaagccucaaccacggaagcaauccugccagaauacggcacccugggacuagagugcagccccagaacagggcucgacuucaacgagaugauacucuuaaccaugaaaaacaaagcauggaugguacaccgccaaugguucuucgacuuaccacucccauggacgagcggggcaaccacagaaacacccacauggaacagaaaagaacucuuagucaccuucaagaacgcacacgccaaaaagcaagaagucguaguccuaggcucacaagaaggagcaaugcacaccgcccucaccggcgcaacagagauacagaacagcggaggaaccucaaucuucgccgggcaccuaaaaugcagacucaaaauggacaaacuugagcuaaaaggcaugaguuacgcgaugugcacaaacaccuucguccucaagaaagaagucucggaaacccaacacggcacaaucuuaaucaaagucgaguacaaaggcgaggacguccccugcaaaauccccuucagcacagaagacggccaaggcaaagcacacaacggcagacuaaucaccgcuaacccuguuguaacaaagaaagaagaacccgucaacauagaggcagagccacccuucggagaguccaacaucgucaucgggaucggcgacaacgcccuaaaaauaaacugguacaagaaaggauccucuaucggaaaaauguucgaggccaccgcacggggagcccgcaggauggccauacuaggagacaccgccugggacuucggaagcguaggaggcguccugaacucccucgggaaaaugguccaccaaaucuucggguccgcauacaccgcacuguucagcggcguaucgugggucaugaaaauaggcauaggaguacuccucaccuggaucggccuaaacuccaaaaacacaucaauguccuucagcugcauagcuaucggaaucauaacccuauaccucggcgcaguaguacaagcauag

SEQ ID NO: 2446 - RNA, 2037 nt, Artificial Sequence
  derived and/or modified CDS sequence (opt11) from DENV-3 Consensus__SSopt-prME
augaaacgaaagaaaacaagccuaugccuaaugaugauccugcccgcagcucucgccuuccaccucacgucaagagacggagaaccaaggaugauagucgggaaaaaugaacgaggcaaaagccugcuuuucaaaacagcaucaggaauaaacaugugcacgcuuaucgccauggaucugggagagaugugcgacgauacaguaaccuacaaaugcccccacauuacagaaguagaaccagaagacauagacugcuggugcaaccucacguccacauggguaaccuacggcacgugcaaccaggcgggcgagcacaggagagacaaaaggagcguggcccuagcgccacacgugggcaugggccuggacacaaggacccaaacauggaugagcgcagaaggcgccuggcgccagguagagaaaguagaaacgugggcacuacggcacccaggcuucaccauccucgcgcucuuucuugcucacuauaucggaacaagccucacgcaaaaaguggugauauucauacuacucaugcuaguaacaccaagcaugaccaugcgcugcgucggggucggcaaccgagacuucgucgaagguuuaagcggggcaacaugggucgacguggugcuagaacacggcggaugcgucacaacgauggcgaaaaauaagccaacucuggacauagaacugcagaagacagaggccacacaacuugccacacugaggaaacuaugcaucgaaggaaaaauaacaaacaucaccaccgacuccaggugcccgacacagggagaagccacgcucccagaggaacaagaccaaaacuacguaugcaagcacacauacgucgaccgcggcuggggcaacggaugcggcuuguucggaaaaggaagccuagucacgugcgcgaaauuucaaugccucgagccaauagaaggaaaaguaguucaauacgaaaaccuaaaauacacagucaucauaaccguacacacaggcgaccaacaccaggugggcaacgaaacgcaaggaguaacggccgaaaucacaccccaggccagcacaacagaggcaauccuacccgaauacggaacccuaggacuagaaugcaguccacgaacuggauuagacuucaacgagaugauacuauuaacaaugaaaaacaaagcauggaugguccaccgucagugguucuucgaccucccucuaccauggaccucaggcgccacgaccgaaaccccaaccuggaacagaaaagaacuccuggucacauucaaaaacgcacacgcaaagaaacaagaagucguaguacuagggucacaagagggugccaugcacaccgcacuaaccggggcaaccgaaauccaaaacagcggcggaacaagcaucuucgcaggucaccucaaaugccgacuaaaaauggacaaacucgagcuaaaaggcaugucguaugccaugugcacaaacacguucguacucaagaaagagguaagcgaaacacaacacggaacaauccuaaucaaagucgaguacaaaggggaagacguccccugcaaaauaccauucagcacagaagacggucaaggaaaggcacacaacggacgacucauaaccgccaaccccguagucacaaagaaagaggaaccaguaaacauagaagcagaaccacccuucggagaauccaacaucgucaucggaauaggagacaacgcauuaaaaaucaacugguacaagaaagggaguucgaucggaaaaauguucgaagccacagcuagaggcgcacgccggauggcaauccugggcgacaccgcgugggacuucggcagcgugggcgggguccucaauagccucggcaaaaugguacaccaaauauucgggagcgcuuacacagcccucuucagcggcgucagcuggguaaugaaaaucggcaucggagugcuccucaccuggauaggacuaaacagcaaaaacaccagcaugagcuucagcugcaucgcaaucgggauaaucacacuauaccugggagcagucgugcaagccuaa

SEQ ID NO: 2447 - RNA, 2037 nt, Artificial Sequence
  derived and/or modified CDS sequence (opt11) from DENV-3 Consensus__SSopt-prME(F108S)
augaaacguaaaaagacaagccugugccugaugaugauccuccccgcugcacucgccuuccacuugacaucacgcgacggcgagccccgaaugaucgucgguaaaaacgagagaggaaaaagccuacuguuuaaaacagccuccgggauaaacaugugcacccucauagcaauggaccucggcgaaaugugcgacgacaccguaacuuacaaaugcccacacaucaccgaaguggaaccggaagacauagacugcuggugcaaccucaccagcacauggguaaccuacggcacgugcaaccaagccggcgaacaccgacgcgacaaaagaagcguagcccuagccccgcacguggggaugggacuugacacacgcacgcagacauggaugagcgcagaaggagcauggcgccaagucgaaaaaguggaaacgugggcacucagacacccaggguucacaauacucgcacuauuccucgcccacuacaucggaacaagccuaacacagaagguagugaucuucauacuacugaugcuaguaacaccgagcaugacuaugcgcugcgucggcguagggaacagggacuucgucgaaggccugagcggagcaaccuggguagauguaguacuagaacacggcggcugcgucaccacuauggccaaaaacaaaccaacccuagacauagaacugcagaaaacagaggcaacacaacuagccacacugaggaaacugugcaucgaaggaaaaauaacaaacauaacgaccgacagccggugcccaacccaaggcgaggcaaccuuaccagaagaacaagaccaaaacuacgugugcaaacacaccuacgucgacagaggaugggggaacggaugcggacuaagcggaaaaggcucccugguaacgugcgcaaaguuucaaugccuagaacccauagagggaaaagucguccaauacgagaaccucaaguacacggugaucaucacaguccacacaggcgaccaacaccaaguaggaaacgaaacacaaggcgucacagccgaaauaacaccacaggccuccaccacagaagcaauccucccagaauacggaacacuaggauuggaaugcagcccccgaacgggucuggacuucaacgaaaugauacuacuaacaaugaaaaacaaagcguggaugguccaccgacagugguucuucgauuuaccacucccguggacaagcggagccacgacagagacaccuacauggaaccgcaaagaacugcuaguaacguuuaaaaacgcacacgcgaagaagcaagaggucgucguccuaggcucucaagaaggcgcaaugcauacggcccucaccggcgcgaccgagauacaaaacuccggaggaaccucaaucuucgcaggccaccucaaaugccgccugaagauggacaaacucgagcuaaaaggcaugagcuaugcaaugugcacgaacacauucguacucaagaaagaggucuccgaaacgcaacacggcacaauccuaaucaaaguagaauacaaaggagaagacgugcccugcaaaauccccuucucaacagaagacggacaaggcaaagcacacaacgggcgccucauaacagcaaauccuguagucacaaagaaagaggaaccaguaaacauagaggcagaaccacccuucggagaaagcaacaucguaaucggaauaggcgacaaugcguugaaaauaaacugguacaagaaagggucaucaaucgggaaaauguucgaagccacggcgcggggcgcacgccgaauggcaauucucggcgacaccgccugggauuucggaagcguaggaggaguccuaaacucgcuaggaaaaaugguccaccaaauauucggaagugcauacacugcguuauucagcggcgugagcuggguaaugaaaaucggcauaggaguacuccugaccuggauaggccucaacagcaaaaacacaagcauguccuucagcugcaucgccaucggcaucaucacacucuacuuaggcgccgucguccaagcauaa

SEQ ID NO: 2448 - RNA, 2037 nt, Artificial Sequence
  derived and/or modified CDS sequence (opt11) from DENV-3 Consensus__SSopt-prME(H27N)
augaaacgcaagaaaacgagccuaugccuaaugaugauccuacccgcagcccuggccuuccaccuaacaucacgagacggcgaaccaagaaugauagucgggaaaaacgagaggggcaaaagccugcuauucaaaacggcauccggaauaaacaugugcacgcucauagcaauggaccuaggagaaaugugcgacgacaccguaaccuacaaauguccccacaucaccgaaguagaaccagaagacaucgacugcuggugcaaccuaacauccacaugggucaccuauggcacgugcaaccaagcaggagaacaccggcgcgacaaaagaagcguagccuuggccccgcacguaggcaugggcuuagacacgcgaacgcaaacguggaugagcgcagaaggggccuggcgacaaguagagaaaguagaaacaugggcacucaggcacccaggguuuaccauacucgcccucuuccucgcgcacuacauaggaaccucacucacgcaaaaagucgugauuuucauccuacucaugcucguaacaccaagcaugaccaugcgaugcgucggcguagggaacagagacuucguagaaggccuaaguggggcaaccuggguagacgugguccuagagaauggcgggugcguaaccacgauggcgaaaaacaaaccaacccuggacauugagcuccagaaaacggaggccacgcaauuggccacacucaggaaauuaugcauagagggaaaaauaaccaacauaacaaccgacaguagaugcccaacccaaggggaagcaacgcucccggaagaacaagaccaaaacuacgugugcaagcauaccuacguagacagaggcuggggcaacggcugcggcuuauucggaaaaggcagccuggucacgugcgccaaauuccaaugccuagagcccauagaagggaaaguaguccaauacgaaaaccugaaauacaccguaaucaucaccguacacacaggcgaccaacaccaaguaggaaacgaaacgcagggaguaacagccgaaauaacaccccaggccuccacaacagaagcaauacugcccgaauacggcacccucggccuagaaugcagcccgcgcacaggacuagacuucaacgagaugauacuccucacaaugaaaaacaaggcguggaugguacaccgacaaugguucuucgaccucccacucccguggacaaguggggccacaaccgaaaccccaaccuggaaccgaaaagaacuccuagucaccuucaaaaacgcacacgccaagaaacaagaagucgucguacuagguucacaagaaggagccaugcacaccgcgcuaaccggugccaccgaaauccaaaacuccggagggacuuccaucuuugccggacaccucaaaugccgccugaaaauggacaaacucgaacucaagggcaugucuuacgcaauguguacaaacacauucguacucaagaaagaaguuagcgagacccaacacggcaccauucugaucaaaguagaguacaaaggcgaagauguacccugcaaaauaccguucaguaccgaagacggccaaggcaaagcccacaacggccggcuaauaacggccaaccccgugguaaccaagaaagaagaacccguaaacauagaagcagaaccacccuuuggcgaauccaacaucguaaucgggaucggggacaacgcccucaaaaucaacugguacaagaaaggcagcucaaucggaaaaauguucgaggcuacggcaagaggagcccgcagaauggcaauccucggagacacagccugggacuucggauccgugggcggaguccuaaacucccucggaaaaaugguacaccaaauauucggaagcgcauacacggcucuauuuaguggcgugagcuggguaaugaaaauaggcauaggaguucuccugacauggaucggguuaaacuccaaaaacacgagcaugagcuucagcugcauagccaucgggauaauaacccuauaccuaggagcaguuguccaagcauga

SEQ ID NO: 2449 - RNA, 2037 nt, Artificial Sequence
  derived and/or modified CDS sequence (opt11) from DENV-3 Consensus__SSopt-prME(T76I)
augaaacgaaagaaaacgagucucugccucaugaugauacuacccgccgcccuagcauuccaucuaacaucaagagacggagagcccaggaugauagucgggaaaaacgaacgcgguaaauccuuacucuucaaaacagccuccggcaucaacaugugcacacucauagccauggaccucggcgaaaugugcgacgacacuguuaccuacaaaugcccccacaucacagaaguugaacccgaagacauugacuguuggugcaaccuaacaaguacaugggucacauacggaacaugcaaucaagcaggcgagcacagacgcgacaaaaggagcguggcccuggccccgcacguggggaugggacucgacacccguacacagacauggaugagcgcagaaggagccuggcggcaaguagagaaagucgaaaccugggcccucagacacccuggcuucaccauacuugcacucuuccucgcgcacuacauaggaacaucacugacacaaaagguaguaaucuuuauccuccuaaugcucgugaccccaucgaugacuaugcgaugcgucggaguugggaacagggacuucgucgaaggccucagcggcgcuacaugggucgacguaguccucgaacacggaggcugcguaaccaccauggccaaaaacaaacccacccuagacauagaauugcaaaagacugaagccacccaacuggccacccuacgcaaacuaugcauagagggaaaaauaaccaacaucacaacagacuccagaugcccaauccagggagaagcaacacuacccgaagaacaagaccaaaacuacgucugcaaacacaccuacgucgaccgcggcuggggaaacggaugcggccuauucggaaaaggaucccucguuacgugugcaaaauuccaaugccucgaaccaauugaaggaaaaguaguccaauacgaaaaccugaaauacaccgucaucauaaccguacacaccggcgaucaacaccaaguaggcaacgaaacacaaggcguaacagcagaaauaacaccacaagccucgacuaccgaagcaauacuccccgaauacgggaccuuaggacuggaaugcagcccacgcaccggccuagacuucaacgagaugauccuacugacgaugaaaaacaaagccuggaugguacacaggcaaugguucuucgaucuccccuuacccuggacgagcggagcaacaaccgaaaccccaacauggaaccgcaaggaacuccuggucacguucaagaacgcgcacgcgaagaaacaagaggucguaguccugggcucacaagagggcgcgaugcauacagcccucaccggcgcgaccgaaauccaaaacuccggcgggacaagcaucuuugcaggacacuuaaaaugccgccugaaaauggacaaacucgaacucaaaggaauguccuacgcaaugugcacgaacacauucgugcuaaagaaagaagucagcgaaacacaacacggaacgauccuaaucaaagucgaauacaaaggggaagacgugcccugcaaaauccccuucaguacagaagacggccaaggaaaggcacacaacggacgccuuaucacugccaaccccguggucaccaagaaagaagaaccagugaacauagaagcagaaccaccauucggcgaaagcaacaucgucaucggaaucggcgacaacgcccuaaaaaucaacugguacaagaaaggcagcucgauaggaaaaauguucgaagccacggcaagaggcgcgagaagaauggcgauacuaggcgacaccgcaugggacuucggaagcguaggcggaguccucaacucacucggcaaaaugguacaccaaaucuucgguuccgccuacacggcccucuucucaggcguaagcuggguuaugaaaauaggcauaggcgugcuccuaacauggaucggccucaacagcaaaaacacaagcaugagcuucuccugcaucgcaauagggaucaucacccuauaccucggcgcagucgugcaagcauga

SEQ ID NO: 2450 - RNA, 2037 nt, Artificial Sequence
  derived and/or modified CDS sequence (opt11) from DENV-3 Consensus__SSopt-prME(N89D)
augaaacguaagaaaacgagccucugucuaaugaugauacuacccgcugcccuagcauuccaucucaccucacgcgacggcgagcccaggaugauaguaggcaaaaacgaaaggggaaaaagccuacuguucaaaaccgccucaggaauaaacaugugcacccuaaucgcaauggaccuuggggaaaugugcgacgacacaguaacauacaaauguccacacaucacagaaguagaaccagaagacauagacugcuggugcaaccuuacgagcacguggguaaccuacggaacgugcaaccaagcgggagagcaccgaagagauaaacgaagcguggcacuagcaccacacguaggaauggggcuggacacgcgaacacaaacauggaugagcgccgaaggagcauggagacaagucgagaaaguagaaacgugggcacucaggcacccaggcuucaccauacuggcccucuuccucgcgcacuauauagggaccucacugacccaaaagguaguaauauuuauuuuacuaaugcuaguaaccccgagcaugaccaugcgaugcguaggagucgggaacagggacuucgucgagggccuaagcggcgcaacguggguagacgugguccucgaacauggaggcugcgucaccacaauggcgaaaaauaaaccaacacuagacauagaacuacaaaagaccgaggccacccaacuagccacgcuaagaaaacuaugcaucgagggaaaaauaacuaacaucacaacagacagccgaugcccaacgcagggggaggcaacacucccagaggaacaagaccaagacuacguaugcaaacacacauacguggacaggggauggggcaacggaugcggucuauucgggaaaggaagccucgucacgugcgcaaaauuccaaugccucgaaccgauagaagggaaaguaguccaauacgaaaaccuaaaauacacagugauaauaacaguacacacaggcgaccaacaccaggugggcaaugaaacgcaagggguaacggcggagaucacaccccaggcaucaaccacggaagcaauccuaccagaguacggcacacuaggccucgaaugcagcccgcgcacagggcuagacuucaacgagaugauccuacuaacaaugaaaaacaaggccuggaugguacaccgacagugguucuucgaccucccgcuaccauggacaucaggggcaacaaccgaaacccccaccuggaaccggaaagagcuccuagucacauucaagaacgcccacgcaaagaaacaagaagucguaguccuaggcagccaagaaggagccaugcauaccgcacuaacuggcgccaccgaaauacaaaacucaggcggcaccucaaucuucgccggacacuugaaaugccgacuaaaaauggacaaacuagaacuaaaaggcaugagcuacgcaaugugcacgaauacauucgugcucaaaaaggaaguaucagaaacgcagcacggcacgauccuuaucaaagucgaguacaaaggagaagacguaccaugcaagauacccuucuccacggaagacggccaaggcaaggcacacaacggcagacugaucacagcaaacccagugguaacgaagaaggaagaaccaguaaauauagaagcagaaccacccuucggcgaaagcaacaucgucaucggaaucggagacaacgcccuaaaaauuaacugguacaaaaagggaaguucgauagggaaaauguucgaagccacagccagaggcgcacgcagaauggcaauccuaggugauacagccugggauuucgggagcgugggcggaguccuaaacucgcuagggaagaugguccaccaaauauucgggagcgcauacacagcccuauucagcggcguaagcuggguaaugaagaucggcauaggcguacuacuaacguggaucggccuaaacagcaaaaacaccagcaugagcuucagcugcauagcaaucggcaucauaacacuauaccucggugcgguaguacaagccuaa

SEQ ID NO: 2451 - RNA, 2037 nt, Artificial Sequence
  derived and/or modified CDS sequence (opt11) from DENV-3 Consensus__SSopt-prME(Y96H)
augaaaagaaagaaaacuagccuaugccuaaugaugauacuccccgccgcccuagccuuccaccucacgucccgagacggagagccccgaaugauagucggcaaaaacgagaggggaaaaucacuacucuucaaaacagcauccgggauaaacaugugcacacuaauagccauggaccuaggagaaaugugcgacgacacaguaaccuacaaaugcccacacaucaccgaagucgaaccagaagacauagacugcuggugcaaccuaaccucaaccuggguaaccuacggaaccugcaaccaagcgggcgagcacagacgcgacaaaagaagcguagcgcucgcaccccacgugggcaugggccuggacacacgaacccaaacguggaugagcgccgaaggcgccuggcgccaaguagagaaaguagaaacuugggcacugcggcacccaggauucacaauacuagcacucuuccucgcgcacuacaucggaaccucacucacucaaaaagucguaauauucauccugcuaaugcuaguaaccccgagcaugaccaugcgcugcgucggaguaggaaaccgggacuucgucgagggccugagcggggcaacauggguggacguaguccucgaacacggcggaugcgugacaaccauggcgaaaaacaaaccaacccuagacauagaacuacagaaaaccgaagccacccaacucgccacccucagaaaacuaugcauagagggcaaaauuaccaacaucaccaccgacagcagaugcccgacacaaggcgaagccacccuccccgaagaacaagaccaaaacuacguaugcaaacacacacacguagaccggggcuggggcaacggcugcggccuguuugggaaaggcagccuggucacgugcgccaaauuccaaugucucgaacccauagagggaaaagucguccaauacgaaaaccucaaauacacagucaucaucaccgugcacacaggcgaccaacaccagguaggcaacgaaacacagggagucaccgccgaaaucacaccacaagcauccaccaccgaagccauacuaccagaauacggaacccucggacucgaaugcucaccacgaacgggucuggacuuuaacgaaaugauucuccugaccaugaaaaacaaagcauggaugguccaccgacaaugguucuuugaccucccccuaccauggacaagcggagccacaaccgaaacacccaccuggaaccguaaggaacuccuggucacguuuaagaacgcacacgcaaagaaacaagaagugguaguacucggcucccaagaaggcgcgaugcacaccgcccuuaccggagccaccgaaauccaaaacagcggcggcaccucgauauucgccggccaccucaaaugccgcuuaaaaauggacaaacucgaacucaaaggaaugagcuacgcaaugugcaccaacaccuucguccugaagaaagaagucucugaaacacaacacgguacaauccucauaaaagucgaauacaaaggagaggacgucccaugcaaaaucccauucagcacggaggacggccagggcaaagcacacaacgggcgccuaaucaccgccaacccggucguaacaaagaaagaggaacccguaaacauugaagccgaaccaccauucggcgagagcaauaucguaauuggcauaggagacaaugcccugaaaauaaacugguacaagaaagggagcuccaucggcaaaauguucgaagccacagcucggggcgcacggcggauggcaauacuaggagacacagcaugggacuucggcucaguaggcggaguccuuaacagccucgggaaaaugguccaccaaaucuucggcucagcauacaccgcccuguucagcggagucucauggguuaugaaaaucggcaucggcgugcucuuaacauggauagggcuaaacagcaaaaacaccuccaugagcuucagcuguaucgccaucggaaucaucaccuuauaccucggagcggucguacaagccuaa

SEQ ID NO: 2452 - RNA, 2037 nt, Artificial Sequence
  derived and/or modified CDS sequence (opt11) from DENV-3 Consensus__SSopt-prME(K110E)
augaagagaaagaaaacaagccuaugccuaaugaugauccugcccgcagcccucgcauuccaccuaacaagccgcgauggcgaaccuagaaugauagucggcaaaaacgaaagaggcaaaagccuacucuucaaaacagccucaggaauuaacaugugcacgcuaaucgcaauggaucugggcgagaugugugacgacacagugaccuauaaaugcccccauaucacggaaguggaaccagaagacaucgacugcuggugcaacuuaacgaguaccugggucaccuacggcacaugcaaucaggccggcgagcaccggcgcgacaaaaggagcguggcccuggcuccgcacguaggcaugggccuggacacacgcacacaaacauggaugagcgcggaaggagccuggcgacaaguagaaaaaguagagacaugggcacucagacacccaggcuuuaccauacucgcgcucuuucucgcgcacuacauagggaccucacuaacacaaaaagucguaauauucauccuacuaaugcucguaaccccaagcaugacgaugcgcugcgucggcgucggcaaccgggacuucguagagggccuaagcggggccaccuggguggacgugguccuagaacacggcggcugcgugaccacgauggcgaaaaacaagccaacccuagacauagaacuacagaaaaccgaggccacacaacuggccacccucagaaaacuaugcauagaaggaaaaaucacaaacauaacgacagacucaaggugcccaacacaaggcgaagccacacuaccggaggaacaagaccaaaacuauguaugcaagcacacauacguggacagaggauggggcaacggcugcggacuguucggcgaaggaagccucgucacaugcgcaaaauuccaaugccuagaacccaucgaaggaaaaguggugcaauacgagaaccuuaaauacaccgugaucauaaccguacacaccggagaccaacaccaagugggcaacgaaacacaaggagucacggccgaaaucacaccacaagcaagcaccacggaagcaaucuugcccgaguacgggaccuuaggccuugaaugcagcccacgcacgggacuggacuucaacgaaaugauacuccuaacgaugaaaaacaaagcguggaugguacaccgacaaugguucuucgaccucccacuucccuggacgagcggagcaacaacagagaccccgacuuggaacagaaaagagcugcuaguaacauucaagaacgcccacgcaaagaaacaagaggucgugguccugggcagccaagaaggcgcgaugcacacagcgcucacaggagcgaccgaaauccaaaacagcgggggaaccagcaucuucgccggucaccugaaaugccgacugaaaauggacaaacucgaacucaaaggaaugagcuacgcaauguguacaaacacguucguacucaagaaagaagucucagaaacgcaacacggcacaauacuaaucaaggucgaauacaaaggcgaggacguaccaugcaaaauccccuuuagcacagaagacggccaaggaaaagcacacaacggaagacucaucaccgcaaauccagugguaacgaaaaaggaagaacccgucaacauagaggcagaaccacccuuuggcgaaagcaacaucgucaucggaauaggagacaacgcacugaagaucaacugguacaagaaaggaagcucgaucgggaaaauguucgaagcaacugcaagaggcgcccgccgaauggcgauccugggcgacacagcaugggacuucgggagcguaggagggguccuaaacucgcucgggaaaaugguccaccaaaucuucgggagcgcauacacggcucuguucucaggagucagcugggugaugaaaauaggcauaggcgugcucuugacauggaucggacuaaauuccaaaaacacgagcaugagcuucaguugcaucgccauaggaaucauaacacuauaccugggcgcaguaguacaagcguaa

SEQ ID NO: 2453 - RNA, 2037 nt, Artificial Sequence
  derived and/or modified CDS sequence (opt11) from DENV-3 Consensus__SSopt-prME(H149N)
augaaacgaaagaaaacaagccuguguuuaaugaugauccuacccgccgcccuggccuuccaccuuacauccagagacggagaaccacgaaugaucguaggcaaaaacgaaagaggcaaaagccuucucuucaaaaccgcuucgggcauaaacaugugcacgcucauagccauggacuugggugaaaugugcgacgacacagucaccuacaaaugcccccacaucacagaaguugagccggaagacauagacugcugguguaaccucaccagcacgugggugaccuacgggaccugcaaccaagcaggcgaacaccgaagagacaaacgaagcguugcccuggcgccccacgucggcaugggccuggacacgcgcacucaaacauggaugagcgcggaaggagcauggcgccagguagaaaaaguggagacaugggcgcucaggcacccaggcuucacaauacucgcacucuuccuagcgcacuacaucggcaccagccucacgcaaaaggucguaaucuucauacugcucaugcucguuacaccaagcaugacaaugcgcugcguaggagucggaaacagagacuucguagaaggacuaagcggagccacauggguagacgugguccuggaacacggcggaugcguaaccacgauggcgaaaaacaaaccaacacuagacauagagcugcagaaaacagaagcuacgcaacuagccacccuaaggaaacugugcauagaagggaaaaucaccaacaucacaaccgacagccgaugcccgacgcaaggcgaagcaacgcucccggaggaacaagaccaaaauuaugugugcaaacacaccuacguagaccgaggcuggggcaacggcuguggacuauucggaaaagggagccuaguaacaugcgcgaaauuccaaugucucgaaccaauagagggcaaaguaguccaauacgaaaaccuaaaauacaccgucaucauaacagugcacacgggcgaccaaaaucaagucggcaaugaaacccaaggagucacagcagaaauaacaccccaggcaagcaccaccgaagcaauccuacccgaauacgggacccucggacuagaaugcagcccacgcaccggccuagacuucaacgaaaugauucuccugaccaugaaaaacaaagcguggaugguccaccgacagugguucuucgaucucccccucccauggaccagcggggccacgacggagaccccaaccuggaacaggaaagagcuccuagucacguucaagaacgcacacgccaagaaacaagaggucguaguccuaggcucgcaagagggcgccaugcacaccgcacuaacgggggcaaccgaaauacaaaacucgggcggaaccucgaucuucgcaggacaccugaaaugccgccuaaaaauggacaagcucgaacucaaaggaaugagcuacgcuaugugcaccaacacauuuguacucaagaaagaagucucggaaacacaacacggcacaaucuugaucaaagucgaauacaaaggcgaagauguaccgugcaaaauaccauuuagcacggaagacggccagggcaaagcacacaacggccgauuaaucacagccaacccaguaguuaccaagaaggaagaacccgucaacauagaagcggaaccuccauucggugagucaaacauagucaucggcaucggggacaacgcccucaaaaucaacugguacaagaaagguagcucgauaggcaaaauguucgaggccacagccagaggcgcgaggagaauggcaauccugggagauacagccugggacuucggaucggugggcgggguacuaaacucgcucggaaaaaugguacaccaaauuuuuggaagcgcguacacagcacucuucucaggggugagcugggucaugaaaauaggcauaggcguacuacuaaccuggauaggacucaacaguaaaaacacaagcauguccuucuccugcaucgcgaucggaauaaucacccuauaccuaggagcagucgugcaagcauaa

SEQ ID NO: 2454 - RNA, 2037 nt, Artificial Sequence
  derived and/or modified CDS sequence (opt11) from DENV-3 Consensus__SSopt-prME(S184F)
augaaacgcaagaaaacaagucugugccuuaugaugaucuuaccugccgcccucgccuuucaccugacaucacgcgacggcgaacccaggaugaucguaggcaaaaaugaaagaggaaagucccuccucuucaaaacugccucaggcauaaauaugugcacgcuaauagccauggaccuaggcgaaaugugcgacgacaccguaaccuacaaaugcccccacaucacagaaguagaaccagaagauaucgacugcuggugcaaccuaacaagcacuuggguaaccuacggaaccugcaaccaagcaggcgaacaccgacgcgacaaacgcagcgucgcccucgccccgcacguaggaaugggacuagacacacgaacacaaacguggaugagugccgaaggagccuggcgccaaguagaaaaagucgaaacaugggcacucagacaccccggcuucaccauacucgcccucuuccuggcccacuauauaggcaccucacuuacccaaaaagucgugauauucauacuacucaugcucgucacacccagcaugacaaugagaugcguaggagucgggaaccgggacuucguugagggccugagcggcgccacauggguggacguaguccucgagcacgguggcugugugacaacaauggccaaaaacaagcccacgcuagacauagaacuacagaaaaccgaagcaacccaacuggccacacuaaggaaacuaugcauagaaggaaaaauaaccaacaucacaaccgacagcagaugcccaacccaaggggaggccacccucccagaagaacaagaccagaauuacguaugcaagcacacauacguagaccgcggcuggggaaaugguugcggacuguucggcaaagggagccuaguuaccugcgcgaaauuccaaugccucgaacccauagaaggaaaagugguccaauacgaaaaccuaaaauacaccguaaucauaaccguccacacgggggaccaacaccaaguaggcaacgaaacacagggaguaaccgccgaaauaacaccacaagccucaaccacagaagcuauccuccccgaauacggcacacucggacuagaaugcuucccccgcacaggccuagacuucaacgagaugauacuccuaaccaugaaaaacaaagccuggaugguacaccgucaaugguucuucgaccucccccucccguggaccagcggggccacaaccgaaaccccaacauggaaccggaaagaacugcuaguaacguucaaaaacgcucacgcuaaaaagcaagagguagugguccuaggaucacaagaaggggcgaugcauaccgcacugacaggggcaaccgaaauacagaacucaggcggcacguccaucuucgccggacaccuaaaaugccgccucaaaauggacaagcuagagcucaaaggaauguccuaugcuaugugcacaaacacuuucguacucaagaaagaagucagcgagacgcaacacggaacgauccuaaucaagguagaauauaagggagaagacguaccaugcaaaauccccuucuccaccgaagacggccagggcaaggcacacaacggccgccuaaucaccgccaaccccguggugacaaagaaagaggaacccgugaacaucgaagccgaacccccauuuggggaaagcaacaucgucaucgggaucggagacaacgcccuaaaaaucaacugguacaagaaaggcucaucaaucggaaaaauguucgaagccacagcaagaggcgcacgucgaauggcaauccuaggcgacaccgcaugggacuucggaucagugggcggcguccuaaacagccucgguaaaaugguccaccaaaucuucggaagcgcauacacggcccuauucagcgggguaagcuggguaaugaaaaucggaaucggcguacuacugacauggauaggacucaacagcaaaaacacaucaaugagcuucagcugcaucgcaauaggaaucaucacccucuaccugggcgccguaguccaagcauaa

SEQ ID NO: 2455 - RNA, 2037 nt, Artificial Sequence
  derived and/or modified CDS sequence (opt11) from DENV-3 Consensus__SSopt-prME(R186L)
augaaacggaaaaaaacaagccugugccucaugaugauccugcccgcugcacuagccuuccaccuaacaucacgagacggcgaaccaaggaugaucgucggcaaaaacgagagaggaaaaagccuacuguucaaaacggcaucgggaaucaacaugugcacccugauagcaauggaccuaggcgaaaugugcgacgacaccgucaccuacaaaugcccccacaucacagaaguggaaccagaagacauugacugcuggugcaaccucacaagcaccugggucaccuacggaaccugcaaccaagcaggcgaacacagaagagacaaacggagugucgcccuggccccgcacgugggcaugggccucgacacgagaacucaaacauggaugagcgcagaaggcgccuggcgccagguagagaaaguugaaaccugggcccuaagacacccaggcuucacaauacucgcccucuuccuagcacacuacaucgggaccucacuaacacaaaagguagucauauucauacuacuaaugcucgugacaccuucaaugaccaugcgcuguguaggagucggaaaccgagacuucguagaaggccucagcggagcgacguggguggacguggugcuagaacacggcggcugcgucaccacaauggcaaaaaacaaaccaacacucgacaucgaacuccaaaaaacagaagcgacccaacuagcaacccuccgaaaacucugcaucgaagggaaaaucacgaauaucaccacagacagcaggugcccuacacagggcgaagcaacgcuuccggaagaacaagaucaaaacuacgucugcaaacauaccuacguagacaggggaugggguaacggaugcggccucuucggaaaaggcagccucgucacaugcgcaaaauuccaaugccuagagccaaucgaaggaaaaguggugcaguacgaaaaccuuaaauacacagucaucauaaccguccacacgggcgaccaacaccaagucggaaaugagacccagggagucacagcagaaaucacaccccaagccuccaccacagaagcgauacucccagaauacggaacccucggccucgagugcagcccacucacgggacuggacuucaacgagaugaucuuauuaacgaugaaaaacaaagcauggaugguacaccgccaaugguucuucgaucuaccacuccccuggacauccggagccacgaccgaaacacccaccuggaacagaaaagaacucuuaguaacauucaaaaacgcacacgccaaaaagcaagaagucguuguccuuggaucacaagaaggagcuaugcauaccgcucuaacuggcgcgaccgagauccagaacuccggaggaaccucaaucuucgccggacaccucaagugccgccuaaaaauggauaaacucgaacugaaaggcaugagcuacgccaugugcaccaacacauucguacugaaaaaagaagucagcgaaacacaacacggcacaauccucaucaaaguagaauacaaaggcgaagacguacccugcaaaauccccuucuccacagaggacggacaaggaaaagcccacaaugggcgccucauaaccgccaacccuguggucaccaaaaaggaagaacccgucaacaucgaagcagaaccacccuucggagagagcaacaucgucauaggaaucggagacaacgcauuaaaaauaaacugguacaaaaaaggaucaucaauaggaaaaauguucgaagccacagcacggggcgcacgccggauggcaauccuaggagauaccgccugggacuucggaagcgucggcgggguccugaacucacucgguaaaaugguccaccaaauauucggaagugccuacaccgcccuauucucaggcgugagcuggguaaugaaaauaggcauaggcguacuccuaacauggauaggacucaacaguaaaaacaccagcaugagcuucagcugcaucgccaucggaauuauaacccuauacuuaggagcaguaguacaagccuaa

SEQ ID NO: 2456 - RNA, 2037 nt, Artificial Sequence
  derived and/or modified CDS sequence (opt11) from DENV-3 Consensus__SSopt-prME(N240S)
augaaacgaaagaaaacgucccuaugccuaaugaugauccuacccgcagcccuggccuuucaccuaaccagccgcgacggcgagccacggaugaucgucgggaaaaacgaacggggcaaaagccuacucuucaaaaccgccucgggcauaaacaugugcacacuuauagccauggaccucggcgaaaugugugacgacaccguaacauacaaaugcccacacauuacagaagucgagcccgaagacaucgacugcuggugcaaccucaccagcacauggguaaccuacggaacgugcaaccaagcgggcgaacacagaagggauaaaagaagcguggcccuagcaccgcacguaggcaugggacuagacacacgaacccaaacauggaugagcgcagaaggcgccuggcgccaaguagaaaaaguggaaacaugggcacucagacacccgggcuucaccauccuagcccuauuccuagcacacuacaucgguaccagccucacacagaaagucguaauauucauacuccucaugcuggucacacccagcaugaccaugagaugugucggggucgggaaccgcgacuucgucgaaggccugaguggggcaacauggguagacgugguacuagaacacggcggaugcguaaccacgauggcgaaaaacaaaccuacccucgacaucgaacugcagaaaacagaggccacacaacucgccacccucaggaaacugugcauagaggggaagauaacaaacaucacaaccgacagccgaugcccaacacaaggcgaagccacgcuaccggaagaacaagaccaaaacuacguaugcaaacacacuuacguggacagaggcuggggcaacggcugcggcuuguucggaaaaggaagccuaguaacaugcgccaaauuccaaugccucgagcccauugaaggaaaagugguccaauacgagaaccucaaauauacaguaaucauaaccgugcacacgggagaccaacaccaagugggaaacgagacacaaggaguuacagccgaaaucacgccacaggccagcacaaccgaagcgauccuaccagaguacggcacauuaggccucgaaugcuccccgagaacaggccuggacuucaacgaaaugauacuccucaccaugaaaaacaaagcauggaugguccaccgccaaugguucuucgaccuaccgcuaccguggacaucaggggccacaaccgaaacaccaacauggaaccggaaggaacuucucguaacguucaagagcgcacacgcgaagaaacaagaggucguaguccuaggcucacaagagggagcaaugcacaccgcccucaccggagcgacagaaauccaaaacucaggagguacgucaaucuucgcagggcaccugaaaugccgccugaaaauggacaaacucgaacuaaaaggcauguccuaugccaugugcacaaacaccuucguacucaaaaaggaaguaucagaaacgcagcacggcacgauacuaaucaagguagaguacaagggcgaagacguacccugcaaaauaccauucagcaccgaagacggccagggcaaagcccacaacggacgauuaaucacagcaaaccccgugguaacaaagaaagaagaacccguaaacauagaagcagaaccaccuuucggagaaagcaacaucgugaucgggauaggagacaacgcccuaaaaauaaacugguacaagaaaggcagcucaaucgggaaaauguucgaggcaacagcacgaggugcgagacgcauggcgauacugggcgacaccgcaugggacuucggaagcgugggcggaguccuaaacucacuaggaaaaaugguacaccaaaucuucggcucggcauacacagcccuauucucgggaguaucaugggucaugaaaauagggaucggagugcuccugaccuggaucggccuaaauuccaaaaacacauccaugucauucagcugcaucgcuaucgggauaauaacccuguaccuaggcgcagucguacaagcguaa

SEQ ID NO: 2457 - RNA, 2037 nt, Artificial Sequence
  derived and/or modified CDS sequence (opt11) from DENV-3 Consensus__SSopt-prME(M258L)
augaaacgcaagaaaacaagccugugccuaaugaugauccugcccgccgcccuagcguuccaccucaccucacgagauggcgaacccagaaugauaguagggaaaaacgagaggggaaagagccuccuguucaaaaccgccucaggcaucaacaugugcacgcugaucgccauggaccucggcgagaugugugacgacaccguaaccuacaaaugcccacacaucacagaagucgaacccgaggacauagacugcuggugcaaccucaccucuacgugggugaccuacggaacaugcaaccaagcgggagaacauagacgcgacaaacgaucaguugcccuagcgccccauguaggaaugggccucgacacacggacccaaacauggaugagcgcagaaggcgcauggagacaagucgaaaaaguagagacgugggcguuacggcacccaggauuuaccauacucgcccucuucuuagcgcacuacaucggaaccucacucacacaaaaaguagucaucuucauucuacuuaugcucgugaccccauccaugacaaugcgcugcguagggguaggaaaccgcgacuucgucgagggacugagcggagccacauggguagacgugguacuagaacacggcgguugcgugacaaccauggccaaaaacaaaccaacgcuagauaucgagcuacagaaaacagaagcaacacaacuagcaacacucaggaaacugugcaucgaagggaaaauaacaaacaucaccacagacagccguugcccaacccaaggcgaagccacgcuaccagaggaacaagaccaaaacuacgugugcaaacacacauacgucgacaggggcuggggcaacggaugcggguuauucggaaaaggaucacugguaaccugcgcgaaguuccaaugccuagagcccauagaagguaaggucguacaauacgaaaaccuaaaguacaccguaaucauaacaguacacacgggcgaccaacaccaagucggaaacgaaacacaaggagucacagcggaaaucacgccccaggccagcaccacggaagcaauacuccccgaauacggaacacugggccuagaaugcagcccacgcacaggucucgacuucaacgagaugauacuucugaccaugaaaaacaaagccuggaugguccauagacagugguucuucgacuuaccacuaccauggacaagcggagcaacaacagagaccccaacauggaacagaaaagaacuauuagucacguucaaaaacgcacacgcgaagaaacaagaaguuguaguacuaggcucacaagagggagcacuccacaccgcgcugaccggcgcgacggagauccagaacuccggagggaccucaauauucgcaggacaccuaaaaugccgccugaaaauggacaaacuagagcucaaaggcaugagcuacgcaaugugcacgaacaccuucguacucaagaaagaggucucagaaacgcaacacggaacaauccuaauaaaagucgaguacaaaggcgaggacguacccuguaaaauccccuucagcaccgaagacggccaaggcaaagcucauaacggacggcucaucacagcaaaccccguaguaacaaagaaagaagaacccgugaacauagaagccgagccacccuucggagagaguaacaucguaaucggaaucggagacaacgcacugaaaauaaacugguacaagaaaggcagcucaaucggaaaaauguucgaggcaaccgccaggggagcacgacggauggcaauccucggcgacaccgcaugggacuucggcucaguaggaggaguccuaaacagccucgggaaaaugguacaccaaaucuucggaagugcguacacagcccuguucucaggcguaaguuggguaaugaaaaucggcauaggcguguuacugacuuggaucggauuaaacagcaaaaacaccagcaugagcuucagcugcauagcaauuggcaucauaacccuauaccuaggcgccgucgugcaagccuaa

SEQ ID NO: 2458 - RNA, 2037 nt, Artificial Sequence
  derived and/or modified CDS sequence (opt11) from DENV-3 Consensus__SSopt-prME(H259N)
augaagcgcaagaaaacaucccuaugccucaugaugauccuaccagcagcacuagccuuccaccucaccagcagagacggcgagcccagaaugauaguggggaaaaacgaaaggggaaaaucccuccucuuuaaaacagcaucaggcauaaacaugugcacccucaucgccauggaccuaggcgaaaugugcgaugacacggugaccuacaagugcccccacauuacagaagucgagcccgaagacaucgacugcuggugcaaucuaaccagcacguggguaaccuacggcacaugcaaucaagcaggcgagcaccgacgagacaagcgaagcguagcacucgccccacacgucggaaugggccucgacacccgcacacaaaccuggaugagcgcagaaggugccuggagacaggucgaaaaaguggaaacgugggcgcuccgccacccaggcuucaccauccucgcccuauuucuugcacacuacaucggaacaucacuaacacaaaaggucgucaucuucauccuacugaugcuggucaccccaagcaugaccaugcgaugcguagggguagguaaccgagacuuuguugaaggccuaagcggggccaccugggucgacguagugcuggaacacggcggaugcguaacuacaauggccaaaaacaaaccaacucucgacaucgaacugcaaaagaccgaagcaacccaacuagcuacacuccgcaaacuaugcauagaaggaaaaauaacaaacauaacaaccgauucccgcugccccacccagggagaggccacacuacccgaggaacaagaccaaaacuacgucugcaaacacaccuacguagacaggggcuggggcaacggaugcggauuauucggcaaaggaagccucgucacaugcgcgaaguuccaaugccucgaaccaaucgaagggaaaguaguccaauacgaaaaccuaaaauacaccgucaucauaaccguccacacgggcgaccaacaccaaguaggcaacgaaacgcaaggcgucacagccgaaaucacaccccaagccucaaccacggaagcaauccuccccgaguacggaacacucggccuagaaugcagcccgcgaacaggacucgacuucaacgaaaugauccuucuaaccaugaaaaacaaagcauggaugguccaccgacagugguucuucgaccucccacuccccuggacaagcggagcaacaacagaaacccccaccuggaacagaaaggaacuacucgucacauucaagaacgcgcacgcgaagaaacaagaagucguaguccuaggaucccaagagggcgcaaugaacaccgcacucacaggcgccacggaaauacaaaacucaggcggaacauccauauucgccggacaccuaaaaugcagacuaaaaauggacaaacuugagcucaaaggcauguccuacgcuaugugcacaaacacauucgugcucaagaaagaagucucagagacgcaacacggaacaauccuaauaaaagucgaauacaaaggcgaagacgucccaugcaaaauacccuucagcacagaggacggccagggaaaagcccacaaugggcgccuaaucacggcuaaccccguggucaccaagaaagaagaacccguaaacauagaagccgaaccacccuucggcgaauccaacauaguaaucggcaucggcgacaacgcccuaaaaauaaacugguacaagaaaggcuccucgauaggaaaaauguucgaagccacggccagaggagcgcgaagaauggcaauacuaggcgauacagcaugggacuucgggagcguaggcgggguucuaaacucgcuagguaaaaugguacaccaaaucuucggaagcgcauacacagcccuauucagcggcguaaguugggucaugaaaauaggcauaggaguacuccugaccuggauaggacuaaacagcaaaaacacaaguaugagcuucagcugcauagcaaucggaaucaucacccuauaccuaggcgccgugguacaagcauaa

SEQ ID NO: 2459 - RNA, 2037 nt, Artificial Sequence
  derived and/or modified CDS sequence (opt11) from DENV-3 Consensus__SSopt-prME(H259R)
augaagcgcaagaaaacaagccugugccuaaugaugauccuaccagcagcccuggcguuccaccuaaccagccgagacggcgaaccaaggaugaucguagggaaaaacgaacgaggcaaaagccuacucuucaaaacagcaucaggcaucaacaugugcacccucauagccauggaccuaggcgaaaugugcgacgacacagucacauauaaaugcccccacaucacagaaguagaaccggaagauauagacugcuggugcaaccucaccagcacaugggugacuuacggaaccugcaaccaagcaggcgagcacagacgggacaaacgaagcguagcccuagcaccccaugugggaaugggccuagacacacgcacacaaacauggaugagcgccgaaggcgcauggcgacaaguggagaaagucgaaacaugggcccucaggcacccaggauucaccauccuggcacucuuccucgcccacuacauaggcaccucccucacucaaaaagucguaauauucauacugcugaugcuagugacacccucgaugaccaugcgcugcgugggcgucgggaacagggacuucguggaaggacuauccggcgccacguggguagacguaguacucgagcacggcgguugcgucacaacaauggccaaaaacaaaccgacccuagacauagaguuacagaaaaccgaagccacacaacuggccacacuaagaaaacugugcauagaaggaaaaauaaccaauaucacgaccgacuccaggugcccaacucaaggagaagcgacccucccggaggagcaagaccaaaacuacguaugcaaacacacauacguggaucgcggguggggcaacggcuguggccuguucggaaaagggagccuagucacaugcgcgaaauuccaaugccucgaacccaucgaaggaaaaguaguacaguacgaaaaccugaaguacaccguaaucaucaccguucacacgggagaucagcaccaaguaggcaacgaaacacaaggcgucacagcagaaaucaccccacaggccucaacaacggaagcaauccuacccgaguacgggacccuaggccuagaaugcaguccacgaacaggacuagacuucaacgaaaugauacugcuaacuaugaaaaacaaagcguggaugguacauagacaaugguucuucgaccuaccacuaccguggaccucaggcgcaaccacagaaaccccaacauggaacaggaaagaacuccuggucacauucaagaacgcgcacgcaaagaaacaagaaguagugguccuagguucacaagaaggagcgaugagaaccgcacucacaggagcgaccgaaauccaaaacucaggaggcacuuccaucuucgccggccaccuuaaaugccgacugaaaauggacaaacuagaacuaaaaggaaugagcuacgccaugugcaccaacaccuucguacucaagaaagagguuuccgaaacacagcacggcacaauccugauaaaagucgaguacaaaggcgaagacgugcccugcaaaaucccauucagcacggaagacggccaaggcaaagcccacaacgggcgccugaucacagccaacccaguggucacgaaaaaggaggaacccguaaacauagaagcagaaccgccauucggugaaagcaacauuguaauaggaauaggggacaacgcgcugaaaaucaauugguacaagaaaggaagcuccaucgggaaaauguucgaagccacagccaggggagcacgccggauggcgaucuugggcgacacggccugggacuuuggaagcguaggaggaguccugaacagccuagggaaaaugguccaccaaauauucggaagcgcauauacagcucuguucucaggcguaagcugggucaugaaaauaggcaucggagugcucuugaccuggaucggccucaacagcaaaaacacgagcaugaguuucagcugcaucgcaauaggcaucaucacccucuaccuaggcgcggucgugcaagcauaa

SEQ ID NO: 2460 - RNA, 2037 nt, Artificial Sequence
  derived and/or modified CDS sequence (opt11) from DENV-3 Consensus__SSopt-prME(A265T)
augaaaagaaagaaaaccucacuuugccuaaugaugauccuucccgcagcccuagcauuccaccuaaccucacgcgacggcgagcccaggaugauagucggcaaaaacgaacgaggcaagagccuacucuucaagacagcaagcggcauaaacaugugcacacuaauagccauggaccugggagaaaugugcgacgacaccgucacauauaaaugcccccauaucaccgaaguagaaccagaagauaucgacugcuggugcaaccucaccaguacauggguaaccuacgggaccugcaaccaggccggcgaacacaggagagacaaaagaucaguagcccuggccccacacguaggcaugggccucgacacacgcacgcaaacauggaugagcgccgagggagccuggcgccagguggagaagguagaaacaugggcucugaggcacccaggauucacaauacuagcacuauucuuagcucacuacauaggaacgagucucacgcagaaagucgugauauucauacuacucaugcucgugacaccgucaaugaccaugcgcugcgucggcguaggaaacagggacuucguagagggcuuaagcggcgcaaccuggguagacgucgugcuagagcacggaggaugcgugaccacgauggccaaaaauaaacccacccuagauauagaacuacagaaaacagaagcaacccaacuagcaacccuaagaaaacuauguaucgagggaaaaauaacaaacaucacgaccgacagcagaugccccacacaaggcgaagcaacacucccagaggaacaagaccaaaacuacgucugcaaacacaccuacguagacagaggcuggggaaacggcugcggacuguucggaaaagggucacucgucacaugcgcaaaauuccaaugccucgagccuaucgagggcaaagucguacaauacgagaaccuuaaauacacaguaaucauaaccguacacacaggcgaccaacaccaagucgggaacgaaacccagggagucacagccgaaaucaccccgcaggcaucaaccacagaagcgaucuuacccgaguacgggacccuaggccucgaaugcagcccgagaacaggacuggacuucaacgaaaugauccuacuaaccaugaagaacaaagcguggauggugcaccgacagugguucuucgaccucccccucccguggacaagcggagccaccaccgaaaccccaaccuggaacagaaaagaacuccuagucacauucaaaaacgcacacgccaagaaacaagaaguaguaguacugggcagccaagaaggcgccaugcacacggcccucacuggaacaaccgagauccagaacagcggcggaaccuccaucuucgcuggccaccuaaaaugccgcuugaaaauggacaaacucgaacucaaggggaugaguuacgccaugugcacgaacacauucguucucaagaaagagguaagcgagacacaacacggaaccauacucauaaaagucgaauacaaaggcgaggacguacccugcaaaaucccauucagcacagaagauggccaaggcaaagcccacaacggacgacucauaacggccaaccccgucgucaccaagaaggaagaaccaguaaacaucgaagcagaaccacccuucggcgagucaaacauaguuaucgggauaggcgacaacgcccucaaaauaaacugguacaagaaaggaucuagcaucggcaaaauguucgaagcaaccgccagaggcgcgcgccgcauggcgauacugggagacacagccugggacuucggaagcgugggcggcguccugaacucauuaggaaaaaugguacaccaaauauucggaagcgccuacacagccuuauucagcggcgugagcuggguaaugaaaaucggcaucggcguacuacucaccuggauugggcucaacucaaagaauaccagcauguccuucagcugcaucgccaucggaaucaucacccuauaccuaggagccguaguccaggcguga

SEQ ID NO: 2461 - RNA, 2037 nt, Artificial Sequence
  derived and/or modified CDS sequence (opt11) from DENV-3 Consensus__SSopt-prME(S296G)
augaaacggaagaaaacgagccuaugccugaugaugauccugcccgcagcacuagcuuuccaccugacaucccgggacggcgaaccaaggaugaucguaggcaaaaacgaaagaggaaaaagccucuuguucaaaacagcgagcggcaucaacaugugcacccucauagcaauggaccucggagaaaugugcgacgacaccguaaccuacaaaugcccacacauaacggaaguagagccggaagacaucgauugcuggugcaaccucaccuccacgugggucaccuauggaacgugcaaccaagcaggcgaacaccgccgcgacaaacgaagcguagcccuagccccacacguaggcauggguuuggauacacgcacgcaaacauggaugagcgccgagggcgcauggagacaaguugaaaaaguagagaccugggcccuacgucacccgggauucacaauccucgcacuuuuccuagcccacuauauaggcaccucgcuaacacaaaaaguaguaauauucauccuccucaugcuaguaacaccaagcaugacaaugcgaugcgucggcguaggaaacagagacuucgucgagggacuaucuggggccaccuggguagacgugguacuagaacacggcgggugcgugaccacaauggcaaagaacaagccgacucuagacauagaauugcagaaaaccgaagccacacaacuagcaacacucagaaaacuaugcauagaggguaaaauaacaaauaucacaaccgauagcagaugccccacacagggagaagcaacccucccggaggaacaagaccaaaacuacguaugcaaacacaccuacguggaccgaggcuggggcaacgggugcggucuauucggcaaaggaagccuggucacgugcgcaaaauuccagugccuagagccgauagaaggcaaaguaguucaauacgagaaccucaaauacacaguaaucauaaccguacacacgggcgaccaacaccaagugggcaacgaaacacaaggagucacggcagaaauaacaccccaggcuucuacaacagaagcaauccuccccgaauacgggacacuaggccuagaaugcagcccgcgcacaggccuagacuucaacgagaugauccucuuaacaaugaaaaacaaagccuggaugguccaccgccaaugguucuucgaccuaccacucccguggacaagcggagccacaacagagacccccaccuggaacagaaaagagcuccuuguaacguucaaaaacgcacacgcgaaaaagcaagaagucguaguccuaggcucacaagaaggcgcgaugcacaccgcacuaacaggcgcaacggagauacagaacucgggcggaaccucgaucuucgccggacaccugaaaugccgcuuaaaaauggacaaacucgagcuaaaaggaaugggcuacgcaaugugcacgaacacauucguacucaaaaaggaaguaucagaaacgcagcacggcaccauccuuauaaaagucgaauacaaaggagaggacguaccaugcaaaauaccauucucaacagaagacggacagggcaaagcucacaacggacgccuaaucaccgccaauccaguaguuacgaagaaagaggaacccgugaacauagaagcagaaccaccauucggcgagucaaacaucguaauaggaaucggagacaacgcccucaaaauaaacugguacaaaaagggaucaucuaucggaaaaauguucgaagccacagccaggggcgcacgcagaauggcgauccucggcgacacagcaugggacuucgggagcgugggcggaguccuaaacucacucggcaaaaugguacaccaaauauucggcagcgcauacacagcccuguucuccggggugagcugggucaugaaaauaggcauaggcguacuacugaccuggauaggccucaacagcaaaaacaccagcaugagcuucagcugcauagcgauuggaaucauaacccuauaucugggcgcagucguccaagcguga

SEQ ID NO: 2462 - RNA, 2037 nt, Artificial Sequence
  derived and/or modified CDS sequence (opt11) from DENV-3 Consensus__SSopt-prME(S311R)
augaagcgcaagaaaaccaguuuaugccugaugaugauccuacccgcggcccucgcauuccaccuaaccucgcgugacggcgaacccagaaugaucgucgggaaaaacgaaaggggaaaaucccuccuguucaagacagcuagcggcauaaacaugugcacacucaucgccauggacuuaggagaaaugugcgacgacaccgucaccuauaaaugcccccacaucacagaaguggaaccagaggacaucgacugcuggugcaaccucaccaguacgugggucaccuauggaacgugcaaucaagcaggcgagcacagacgagauaaaagaagcguagcccucgccccgcacguaggcaugggacucgacacacgcacccaaaccuggaugagcgcagaaggagccuggcgucagguagaaaaagucgagaccugggcacuuaggcaucccggcuucacaauacucgcacuuuuccucgcccacuauauaggaacaucccucacacaaaaggucgugaucuucauccugcucaugcucguaaccccaagcaugacuaugagaugcgucggcgucggaaacagagacuucgucgagggacucagcggggccaccuggguggacguaguacuggaacauggcggaugcguaaccaccauggcgaaaaacaaaccaacccucgacaucgaacugcagaaaacagaagccacccaacucgcaacacuaagaaaauuaugcaucgaaggaaaaauaacaaacaucacaaccgauucgaggugcccaacucaaggugaagcaacccuccccgaggaacaagaccaaaacuacgugugcaaacacacauaugucgacaggggauggggaaacggcugcggccuguucgggaaagggagccuaguaaccugcgcaaaauuccaaugccuagaacccauagaagggaaagugguccaguacgagaaccugaaauacacaguuauaaucaccguacacacaggagaccaacaucaagugggaaacgaaacacaaggcguaaccgccgagaucacgccccaagccagcacaacagaagcgauccuacccgaauacgggacccucggccuggaaugcagcccccgcacgggacucgacuucaacgaaaugauacuccugacaaugaaaaacaaagcguggaugguccaccgccaaugguucuucgaccuaccgcucccauggaccagcggggccacgacagaaacaccgaccuggaacaggaaggagcuacucgucacguucaagaacgcacacgcuaaaaagcaggaagucgucguacuggggagccaagaaggcgcaaugcacacagcccucacaggcgcgaccgagauccaaaacagcggcgggacgucaaucuuugccgggcacuuaaagugcagacuaaaaauggacaagcuagagcuaaaaggaauguccuacgccaugugcacgaacacauucgugcucaagaaagaggucagagagacgcaacacggaaccauauugaucaaaguagaauacaaaggcgaggacguccccugcaaaauccccuucaguacggaagacggacaaggaaaagcccacaacggacgcuuaaucacagcaaaccccguaguaaccaagaaagaagaacccguaaacauagaggcagaaccgcccuucggcgaaagcaacauagucaucggaaucggcgacaacgcccucaaaaucaacugguacaagaaaggcagcuccaucgggaaaauguucgaagcaaccgccagaggagcgcgcagaauggcaauccuaggcgauacagcaugggacuucggaagcguaggcggcguccucaacucucucggaaaaaugguccaucagaucuucggaagcgcguacacagcccuauucucgggcguaaguuggguaaugaaaauaggaauaggcguacuauuaacauggaucgggcuaaacagcaaaaauacgucaaugagcuucaguugcauagcgauuggcauaaucacauuauaccuaggugccgucguacaagccuga

SEQ ID NO: 2463 - RNA, 2037 nt, Artificial Sequence
  derived and/or modified CDS sequence (opt11) from DENV-3 Consensus__SSopt-prME(K321T)
augaaaagaaagaaaacaagccuaugcuuaaugaugauacuccccgcggccuuggcauuccaccuaacaucccgcgacggcgaacccaggaugauaguaggcaaaaacgaaagaggaaaaagccugcuauuuaaaacggcaagcggcaucaacaugugcacccucauagccauggacuuaggcgaaaugugcgacgacacaguaacauauaaauguccccacaucaccgaggucgaacccgaagacaucgauugcugguguaaccucacgagcacgugggugacauacggcacaugcaaccaagcgggagagcaccgacgcgacaaacgaaguguagcccuagccccgcacgucggcaugggacuggacacgcguacacaaacguggaugagcgcagaaggagcguggcggcaggucgaaaaaguagagacaugggcccucaggcacccaggauucaccauacucgcgcuauuccucgcccacuacauaggaaccagucucacucaaaaagucgucauauuuauccuacucaugcuaguaaccccgagcaugaccaugcgaugcgucggaguagggaacagagacuucguggaaggccugagcggagccaccuggguagacgugguccucgaacacggcgggugcguaaccacaauggcgaaaaacaaaccaacucuggacauagaacuucaaaagaccgaagccacccaacuggccacacuccgaaaacugugcauugaagggaaaauaaccaacaucacaaccgacagcagaugcccaacccaaggagaagcaacacucccagaggaacaagaccaaaacuacguaugcaaacacacauacguggaccgcggcuggggaaacggaugcggccuauucgguaaaggcucccucguaacgugcgcaaaauuccaaugccuagagccaauagaaggcaaagucguccaauaugaaaaccuaaaauauaccgucaucaucaccguacacaccggcgaccaacaucaaguaggaaacgaaacccaaggggucacggccgagaucacaccacaagccucaaccacagaagccauacuaccagaauacggcacacugggacuagaaugcagcccccgaacaggacuagacuucaacgaaaugauacuccugacaaugaaaaauaaagcauggaugguccaccgccaaugguucuucgaccuaccccucccguggaccuccggugcaaccaccgaaacaccgaccuggaaccgcaaagagcuccucguaacguucaaaaacgcacaugcaaagaaacaagaagucgugguccuaggcucucaggaaggcgcgaugcacaccgcacuaaccggcgcaacagagauccaaaacucaggcgggacaucaaucuucgccggccaccucaaaugccgccuuaaaauggauaaacucgaacucaaaggcaugagcuaugcaaugugcacaaacacauucguacucaagaaagaagucucagaaacacaacacggcacaauccugaucacggucgaguacaaaggcgaagacgucccaugcaaaaucccauucaguacggaggacggacaaggcaaagcccacaacggccgccuaaucacagccaaccccguggucacgaagaaagaagaacccguaaacauugaagcggaaccgccauucggcgaaagcaacaucguaaucggaaucggcgacaacgcacugaaaauaaacugguauaagaaaggcuccucaaucggaaaaauguucgaagccaccgcaagaggagcacgaaggauggcuauccucggcgauaccgcuugggauuucgggucagucggcggaguacucaacucacucggaaaaauggugcaccaaauauucggcagcgcauacaccgcacucuucucaggcgugagcugggucaugaaaauaggcauaggcguacuccucaccuggaucgggcucaacagcaagaacacgagcaugaguuucuccugcaucgcaaucggaaucaucacucucuaccugggagcagucgugcaagcguaa

SEQ ID NO: 2464 - RNA, 2037 nt, Artificial Sequence
  derived and/or modified CDS sequence (opt11) from DENV-3 Consensus__SSopt-prME(G28C,H242C)
augaaacgaaagaaaacgagccucugccugaugaugauacuaccagccgcccuagccuuccaccucaccagccgagacggagaacccagaaugaucgucgguaaaaacgagaggggaaaaagccuacucuuuaaaacagccucaggcauaaacaugugcacacuaaucgccauggaccuaggagagaugugcgaugacaccgucaccuauaaaugcccccacaucacagaagucgaaccggaagacaucgacugcugguguaaccuaacgagcacaugggucaccuacggcacaugcaaccaagccggcgaacaccgacgcgacaaacgcagcguagcccuagccccgcacguaggcaugggacuagacacccgcacgcaaacguggaugagcgcagaaggagccuggcgacaagucgagaaaguagaaacgugggcacuccgacacccgggcuucaccauacucgcccuauuucucgcacacuacaucgguaccucccuaacacaaaaaguaguaauauucauccuacuaaugcuuguaaccccaagcaugacaaugcgcugcgucggaguagguaaccgagacuucguagaaggccucagcggggccacguggguagacgucguccuggagcacugcgggugcgucaccacgauggccaagaauaaaccgacccuagacauagaacuucaaaagacagaggcgacacaacucgccacacuccggaaacuaugcauagaaggaaaaaucaccaacauaacgaccgacagccgaugcccgacacaaggcgaagccacacuaccagaagaacaagaccaaaacuauguaugcaaacacacguacgucgacagaggcuggggaaacggcugcggacuauucggcaaagggucccucgucacgugcgcaaaguuccaaugucucgaaccaauagaaggaaaagugguccaauacgaaaaucucaaauacacagugaucauaaccguccacaccggagaccaacaccaaguaggcaaugaaacacaaggagucacagccgaaauaacaccucaggcgucaacaaccgaagcaauucuaccugaauacggaacccuaggccucgaaugcaguccacgcacaggacucgacuucaacgaaaugauacuccugacaaugaaaaacaaagccuggaugguacaccgccaaugguucuucgaccuaccacucccguggacaaguggcgccacaaccgagaccccaaccuggaaucgcaaagagcuccuagucaccuucaaaaacgcaugcgcgaaaaagcaagaagucgucguccuggggagccaagaaggcgcaaugcauaccgcacuaacaggcgcgaccgagauccaaaacucagggggaacaagcaucuuugccggacaccuaaaaugccgacucaaaauggacaaacuugaacucaaaggaaugagcuaugccaugugcacaaacacauucguacuaaagaaagagguaucagaaacacaacacggcaccauccuaauaaaaguugaauacaagggcgaagacguccccugcaaaauacccuucagcacagaagauggacaaggcaaggcccacaacgggcgacucaucacagcaaacccaguagucacuaagaaagaagaacccgucaacauagaagccgaaccgcccuucggcgaaagcaacauagucaucggaaucggagacaacgcccugaaaauaaacugguacaagaaagggagcaguauaggcaaaauguucgaagcgacagccaggggugcccgcagaauggcgauacugggcgacacugcaugggauuucgguagugugggcgggguccugaacucacuagggaaaaugguacaccaaauauucggcagugcauacacggcccuguucucaggcgucagcugggucaugaaaauuggcauaggcguacuccucaccuggaucggacuuaacagcaaaaacacaagcaugaguuucagcugcauagcaaucgggaucauaacccuguaccugggcgcugucguccaagcauaa

SEQ ID NO: 2465 - RNA, 2037 nt, Artificial Sequence
  derived and/or modified CDS sequence (opt11) from DENV-3 Consensus__SSopt-prME(R186L,A265T)
augaaacgcaagaaaacgagccugugccugaugaugauccuacccgccgcccuggccuuccaccuaaccuccagagacggcgaaccccgaaugauaguaggcaaaaacgaacgaggaaaaagccuccuauucaaaacggcaucaggaauaaacaugugcacgcucaucgccauggaucucggcgaaaugugugacgacaccgucaccuacaaaugcccccacaucacagaagucgaaccagaagacaucgacuguuggugcaaccuaacgagcacaugggucaccuacggcacgugcaaccaagcaggcgaacaccggcgagacaaaaggucagucgcccucgcgccccacgucggaaugggccuugacacgcgcacacaaaccuggaugucagcggagggagccuggaggcaagucgaaaaagucgaaacaugggcacucaggcacccaggcuucaccauacuugcccucuuccucgcccacuacaucggcaccucacucacccaaaagguaguaaucuucaucuugcuaaugcucgugacaccgagcaugacaaugcgaugcguaggggucggaaacagagacuucgucgagggccuaucaggagccaccuggguagacguaguccuggagcacggaggaugcguaacaacaauggccaaaaacaaacccacccuggacauagaacuccaaaagaccgaagcaacacaacuagcaacgcuaagaaaacucugcaucgaagggaaaaucaccaacauuacaacagacagccgaugccccacucagggcgaagccacacuaccggaagaacaagaccaaaacuacguauguaaacacaccuacguggacagaggaugggggaacgggugcggcuuguucggcaaaggaucucuaguuacgugcgcaaaauuccaaugccucgagcccauagaaggcaaagugguccaauacgagaaccuaaaauacacaguaaucauaaccguccacacgggagaccaacaccaaguaggaaacgagacacaaggcguaaccgccgaaaucacaccccaggccuccacaacagaggcaauacuccccgaauacggaacccugggacucgaaugcucaccacucaccggacuagacuucaacgaaaugauacuucugacgaugaaaaacaaagcauggaugguacacagacagugguucuucgaccuaccuuuaccauggaccagcggagcaacaaccgaaaccccaaccuggaaccgcaaagaacuccuagucaccuucaagaacgcgcacgcaaagaaacaggaggucguaguccuaggcagccaagaaggugccaugcacaccgcccuaaccggcaccacagaaauccaaaacagcggcggcaccuccauauuugccgggcaccucaaaugcagacugaaaauggacaaacuagagcucaaaggcauguccuacgccaugugcacaaacaccuucguccuaaagaaagagguauccgaaacccaacacggcacaauacugaucaaaguagaauacaaaggagaagacgugcccugcaaaauaccauucuccacagaagacggccaaggaaaagcccacaacggaagacuaauaacagccaacccagucguaacaaagaaagaggaaccagugaacaucgaggcagaaccacccuucggcgaaagcaacaucguaauaggaaucggcgacaacgcucucaaaauaaacugguauaagaaaggcagcucaaucggaaaaauguucgaggccacggcacgaggcgcacgccgaauggcaauccuaggcgacacagcaugggacuucggcagcguaggcggcguacucaacagucuaggaaaaaugguccaccaaauauucggaagcgccuacacggcccuauucuccggagugaguugggucaugaaaauaggcaucggaguacuucugacauggaucggccucaacagcaaaaacaccagcauguccuucagcugcaucgcgaucgggauaauaacccuauaccuaggagcggugguacaagcauaa

SEQ ID NO: 2466 - RNA, 2037 nt, Artificial Sequence
  derived and/or modified CDS sequence (opt11) from DENV-3 Consensus__SSopt-pr(D104A)ME(F108S)
augaagcggaagaaaacgagccugugccucaugaugauacugcccgcggcccuagcauuucaccuaaccucgagagacggcgaacccaggaugauaguagggaaaaacgaaaggggcaaaagccugcuauucaaaacggcaucgggcaucaacaugugcacacucauagccauggaccuaggggagaugugcgacgacaccgugaccuacaaauguccccacaucaccgaagucgaaccggaagacaucgacugcuggugcaaccucaccaguacaugggugaccuacggcacaugcaaccaagcaggcgagcacaggagagcaaaaaggagcgucgcccuggcaccacacguaggaaugggacucgacacgcgaacacaaacauggaugagcgcagaaggagccuggcgccaggucgagaaaguggaaacgugggcgcucaggcacccgggcuucaccauccuugcccucuuccucgcucacuacaucggcacaucgcuaacacaaaaagucgugauauucauacuacuaaugcucgugaccccgagcaugaccaugcgaugcgucgggguagggaaccgagauuucgucgaaggauuaagcggagccacauggguggacgucguccuggaacauggcgggugcgucaccacgauggccaaaaacaaaccgacccuggacauagaacugcagaaaacugaggccacgcaacuagccacgcugcgaaagcugugcauagaagggaaaauaaccaacaucacaaccgacaguaggugcccaacgcaaggcgaagcuacacuaccagaagaacaagaccaaaacuacguauguaaacacacauacguggaccggggauggggcaacgguuguggacuaagcggcaaaggaagccuggucacgugcgcaaaauuccaaugccuugagccaauagaaggaaaagugguccaauacgagaacuuaaaauacaccguaaucauaaccguacauacgggagaccaacaccaaguaggaaacgaaacacaaggagugacagcagaaaucacaccacaggccagcacaacggaagccauacuacccgaguacgggacccuggggcuggaaugcagcccgcgcacgggauuggacuucaacgaaaugauucuccugacuaugaaaaacaaagcauggaugguucaucgccagugguucuucgaccucccgcucccguggacaagcggggccacgacagaaaccccaaccuggaaccggaaagagcuccuagucacauucaaaaacgcacacgcgaaaaagcaagaagucguaguacugggaucgcaagagggagcaaugcacacggcacucacgggugcaacagagauccaaaacucgggcggcaccagcauauucgcaggacaccugaaaugccgccuaaaaauggacaagcuagagcuaaaaggcaugagcuacgccauguguacgaacacauucguacuuaagaaagaagucucggaaacucaacacggcacaauccucauaaaagucgaauacaagggagaagacgucccaugcaaaauaccguucuccacagaagacggccaaggcaaagcccauaacgggcgacugaucacggccaaccccguagucaccaaaaaggaggagcccgucaacauagaagcggaaccgcccuucggagagagcaauaucguaauagggaucggagacaacgccuuaaaaauaaacugguacaagaaagggagcucaauaggcaaaauguucgaagccacagccaggggcgcgcgcagaauggcgauccucggcgacacagcaugggacuucggauccguaggagggguccuaaacucgcuaggaaaaaugguucaccaaaucuucggaagcgcuuacacggcacuguucagcggagugagcugggucaugaaaauaggcaucggagugcuccugacauggaucggacucaacaguaagaacacgagcaugaguuuuagcuguauagcgaucgggaucauaaccuuauaccuuggagcgguugugcaagcauga

SEQ ID NO: 2467 - RNA, 2037 nt, Artificial Sequence
  derived and/or modified CDS sequence (opt11) from DENV-3 Consensus__SSopt-pr(D104A)ME(R186L,A265T)
augaaacgcaagaaaacaagccugugucuaaugaugauacugccagccgcccucgccuuucaccucacgucacgcgacggagaaccccggaugauagucggcaaaaacgagcgaggaaaaagccugcuguucaaaaccgccuccgguauaaacaugugcacccucauagccauggaccuaggcgaaaugugcgacgacaccguaaccuacaaaugcccccacauaacagagguagaaccggaagacauagacugcuggugcaaccucacaagcacaugggugacauacggcacaugcaaccaagcgggagagcaccggcgcgcaaaaagaagcgucgcccucgcaccgcacgugggcaugggccuugacacgcguacccaaacauggauguccgcagaaggagccuggcgccaaguagaaaaagucgaaaccugggcccucagacacccaggcuucacaauacucgcauuauuccucgcacacuauauaggaacaagucuaacucaaaaagucgugauauucauccuccucaugcucguaacgccgagcaugaccaugcgcugcgucggaguaggaaaccgagacuucgucgagggacuaagcggagcaacauggguagacgugguacuagaacacggaggaugcgugaccaccauggccaaaaacaagcccacgcucgacauagaacuacagaaaaccgaagcaacccagcuggccacgcuacgaaaacuaugcauugaaggaaaaaucacuaacaucacaaccgacucacgcugccccacccagggcgaagcgacccuccccgaggaacaagaccaaaacuauguaugcaaacacaccuacguagaccgaggcuggggcaacggcugcggccucuucggaaaggggucccuaguaaccugcgccaaauuccagugccucgaaccaauagaaggaaaaguaguccaauacgaaaaccuaaaguacaccgugaucaucacaguacacacgggcgaccagcaccaagucggaaaugaaacacaaggaguuaccgcggaaauaacaccacaggcauccacaacagaagccauccuacccgaauacggaacacugggccuagaguguagcccacuaaccggccucgacuucaacgaaaugauacuccucaccaugaaaaacaaagccuggaugguccaucgccaaugguucuucgaccucccgcuaccauggacaucaggagcaacaaccgaaaccccaaccuggaaccgcaaagagcuccuaguaacguucaaaaacgcgcacgcaaagaaacaagaggucgugguccugggaagccaagaaggcgccaugcacaccgcucucacaggcacgaccgaaauccagaacagcggcggaaccuccaucuucgcaggacacuuaaaaugccgccucaaaauggacaaacucgaacuaaaaggcaugagcuacgccaugugcacaaacacauucguguuaaagaaagaaguaagcgaaacccaacacggaacuaucuugauuaaaguggaauacaaaggagaagacguacccugcaaaaucccuuucagcacagaagacggacaaggcaaagcccacaacggacgccuaauuacagcaaacccaguggucacaaagaaagaggaaccgguaaacauagaagcagaaccgccauucggcgagagcaacaucguaaucgggaucggagacaacgcacucaaaauaaacugguacaagaaagggucauccaucggaaaaauguuugaagcaacagcgagaggcgcacgccgaauggcaauccugggcgacacagcaugggacuucggaagcgugggcggcguccugaacucccucgggaaaaugguacaccaaauauucggaagcgcguacacagcccuauucuccggcgucagcugggucaugaaaaucggcauaggcguccuacuaaccuggauaggacuaaacagcaaaaacaccaguaugaguuucagcugcaucgcgaucggaaucaucacccuauaccucggcgccguaguccaagcguaa

SEQ ID NO: 2468 - RNA, 2037 nt, Artificial Sequence
  derived and/or modified CDS sequence (opt11) from DENV-3 Consensus__SSopt-pr(D104A)ME(F108S,R186L,A265T)
augaaacgcaagaaaacgagccuaugccugaugaugauccuacccgcagcacuagccuuccaccugacaagccgcgacggcgaaccgcgcaugaucguggggaaaaacgaacgaggaaaaagccuacuguucaaaacagcuagcggcaucaacaugugcacccuuauugcaauggauuuaggagagaugugcgacgacacagugaccuacaaaugcccccacaucaccgaaguggagccagaagauaucgacugcuggugcaaccuaacaucaacauggguaaccuacggaacuugcaaccaagccggugaacaccgccgggccaaaagaagcgucgcacuggccccacacgucggcaugggccuagacacucggacacaaacguggaugucggcggaaggcgccuggcgacaagucgaaaaaguagaaaccugggcgcucagacauccaggcuucacgauacuagcccucuuccucgcgcacuacauaggaacaagccuuacccaaaaaguaguaauauucauacuccucaugcucgucaccccaagcaugaccaugcgcugcguaggcgucgguaaccgagacuucguagaaggacuaucgggagccaccuggguggacgugguacuagaacauggaggcugcgucacaaccauggcuaaaaacaaaccaacccuagacaucgaacuacagaaaaccgaagcaacacaacucgcaacccucaggaaacucugcaucgaagguaagaucaccaacaucacgaccgacagccgcugcccaacucaaggcgaagcgacacuaccggaagaacaagaucagaacuacguaugcaaacacacauacgucgacagaggauggggcaauggcugcggacuaagcggaaaaggcagccuaguaaccugcgcaaaauuccaaugccucgaacccaucgaagguaaggucguacaauacgaaaaccucaaauacacaguaaucaucacaguccacaccggcgaccaacaccagguuggcaacgagacacaaggagugacggccgaaaucacaccccaagcaucaaccaccgaagcgauccuccccgaauacggaacccugggccucgaaugcagcccccucacaggccucgacuucaacgaaaugauucuacucacaaugaaaaacaaagccuggauggugcaccgccaaugguucuucgaccugccccuacccuggaccagcggagccacgacagaaacaccaaccuggaaccgcaaagagcuccucgucacauucaaaaacgcccaugccaagaaacaagaaguagucguccuaggaucacaagaaggcgcaaugcacaccgcccucacaggaaccaccgagauccaaaacaguggcggaaccuccauauucgcgggacaccucaaaugucgccugaaaauggacaaacuggagcuaaaaggaauguccuacgccaugugcaccaacacauucguacuaaagaaagaagucucagaaacccaacacggaacaauacucaucaaagucgaauacaaaggagaggacgucccguguaaaaucccauucagcacagaagauggccaaggaaaagcccacaacgggagacuaaucacagccaaucccgucgucaccaagaaagaggaaccagucaauaucgaagcggaacccccguucggcgaaagcaacauaguaauaggcaucggagacaacgcacucaaaaucaacugguacaagaaagggagcucgauaggcaaaauguucgaagccacagcaaggggcgcgcgaagaauggccauccucggcgacacagcaugggacuucggcagcguaggcggaguccuaaacucucuaggcaaaaugguccaccaaaucuucggcagcgcauacaccgcccuguucuccggcgugucauggguaaugaaaauaggcauaggaguccuacugacauggaucggacucaacagcaaaaacacgucaauguccuucuccugcaucgcaauagggaucauaacccuauaccucggagcaguaguccaagccuga

SEQ ID NO: 2469 - RNA, 2016 nt, Artificial Sequence
  derived and/or modified CDS sequence (opt11) from DENV-3 Consensus__SSopt-prMEdel101-107,(R99P,F108N)
augaaacgcaagaaaacaucucucugccucaugaugauccuccccgcagcucucgcguuccaccucacaagcagagacggggagccccgcaugauaguaggcaaaaacgaacgcggcaaaucacuccuuuucaaaacagccucaggaauaaacaugugcacacucauagccauggaccucggcgaaaugugcgacgacacagucacguacaaaugcccgcacaucacagaaguagaaccagaagacauagacugcuggugcaaccuaacaucuacaugggucaccuacggaaccugcaaccaagccggcgagcaccgaagagacaaacgcucagucgcccucgccccacacgugggaaugggacuagacacaagaacccaaaccuggaugucagcagaaggcgcguggcggcaagucgagaaagucgaaaccugggcccuacgccacccaggcuucacuauccuugcccucuuccucgcacacuacauaggcaccucccuaacacagaaaguaguaaucuucauacuacuaaugcuagucacgcccucaaugacaaugcgcugcgucggcguaggaaaccgagauuucguagaaggacuaucaggagcaacgugggucgacguaguucuagaacacggcggcugcgucacgacaauggccaaaaacaaacccacacuugacaucgaacuccagaaaacagaagcaacccaacuagcaaccuugcgcaagcucugcaucgaaggaaaaaucacaaacaucaccacagauucacgcugcccaacgcaaggcgaagcaacccuacccgaagaacaagaccaaaacuacgucugcaaacacacauacgucgacccgggcaacgggaaaggaagucuagugaccugcgcaaaauuccaaugccucgagccaaucgaagggaaagucguccaauacgaaaaccuaaaauacaccgucauaaucacaguccacacgggcgaccaacaccaaguaggaaacgaaacucaaggcgucaccgcagaaaucaccccacaagccuccacgacagaagcgauccuccccgaauacggcacacucggccuugagugcucaccccgaacaggacuagacuucaacgagaugauacuacuaacgaugaaaaauaaagcauggaugguccacaggcaaugguucuucgaccucccgcuccccuggaccucgggggccacaacagaaacaccaacuuggaaccgaaaagaacuccucgugaccuucaagaacgcacacgcaaagaaacaagaagucgucguccuaggcucacaggagggcgcuaugcacacagcccucacaggggccacagagauucaaaacuccggcggcaccuccaucuucgccggacaccuaaaaugccgacuuaaaauggacaaacuggaacucaaaggcaugucauacgccaugugcacaaauaccuucguccuaaagaaagaagucagcgaaacgcaacacggcaccauccuaauaaaaguagaguacaaaggagaagacgucccaugcaaaauccccuucagcaccgaagacggccaaggcaaagcacacaacggacgacuaauaaccgccaaccccguaguaacaaagaaagaagaacccgucaacauagaggcagaaccucccuucggcgaaagcaacauaguaaucggcauaggcgacaacgcacugaaaaucaacugguacaagaaagggaguuccaucgggaaaauguucgaagccacagcccgcggagcacgacgcauggccauccuaggagacacagccugggacuucggguccgugggagguguccucaacucacuaggaaaaaugguccaccaaauauucggauccgccuacacagcacuauucucuggcgucucaugggucaugaagauuggaaucggcguccuccugaccuggauaggacuuaacaguaagaacacgagcaugagcuucagcugcauagcaaucggcaucaucacgcucuaccuaggcgccguaguacaggccuaa

SEQ ID NO: 2470 - RNA, 2037 nt, Artificial Sequence
  derived and/or modified CDS sequence (opt11) from DENV-3 Consensus__SSopt-prMEdelstem_TM-JEV
augaagcgcaagaagacaucccucugucugaugaugauccuaccugcagcacuagcauuccaccugacaagcagagauggcgaacccagaaugauaguaggaaagaacgaaagaggcaaaagucuccuauucaaaacugccuccggaaucaacaugugcacgcuaauagccauggaccuaggagaaaugugcgacgacaccguaaccuacaaaugcccccacaucacggagguggaaccagaagacaucgacuguuggugcaaccuaacaagcacgugggucaccuauggcacaugcaaccaagcaggcgagcaccggcgagauaaacggagcguggcucuggccccacacgucggaaugggcuuagacacccgaacgcaaacauggaugucagcggaaggagccuggagacaagucgaaaaaguggaaacaugggcacucaggcacccgggcuucacaauccucgcacucuuccucgcgcacuacaucggaaccagucuaacacaaaaagucguaauauucauccuacuuaugcuagugacaccaagcaugacaaugagaugcgugggcgucggaaacagagacuucgucgagggccuaagcggggccacuuggguggacgugguccuagaacacggcggaugcguaacaaccauggcgaaaaacaagccaacccuagacauagagcuacagaaaaccgaagccacacaacuggccacacucagaaaacuaugcaucgaaggaaaaauuacaaacaucacaaccgacagcagaugccccacccaaggcgaagccacacucccggaggaacaagaucaaaacuacgugugcaagcacaccuacguggaccggggcuggggcaacggcugcggacuauucgggaaagggagcuugguaacgugcgcaaaauuucaaugccucgagcccauagaaggcaaagucguacaguaugagaacuuaaaauacaccgucauaaucaccguacacacgggagaccaacaccaaguaggcaacgaaacacaaggggucacggccgaaaucacgccccaggccagcaccacagaagcaauccucccagaauacggcacacucggacuagaaugcagcccgcgcacaggccuagacuucaacgaaaugauacuccuaacaaugaaaaacaaagcguggaugguccaccgucaaugguuuuucgaccuaccccuaccguggacaagcggagcgacaaccgaaacccccacauggaacagaaaagagcugcuagucacguucaaaaacgcacacgcgaaaaagcaagaaguagugguccuaggcucacaagagggcgcaaugcacaccgcacuaaccggggcgaccgaaauacaaaacucgggaggaaccuccaucuucgccggccaccugaagugucgacucaaaauggauaaacucgagcugaaaggcauguccuacgccaugugcaccaacacauucguacucaagaaagaagucagcgaaacccaacacggcacaauacuaaucaaagucgaauacaaaggcgaagacguccccugcaaaauaccauucagcacagaagacggccaggguaaagcccacaacggacggcucaucacggccaaccccguaguuacgaagaaagaggaacccguaaacauagaagcagaaccgccauucggcgagagcaacaucgucaucggaauaggagacaacgcacuaaaaauaaacugguauaagaaaggguccacacuaggaaaagcguucagcaccacacuaaaaggagcucaaaggcuugcagcccugggcgacaccgcaugggacuucggcagcauaggaggggucuucaacuccaucgggcgcgcaguacaccaaguauucgguggcgcauucagaacucuauucggagguaugagcuggaucacgcaaggccuaaugggcgcacuccuacucuggaugggggucaacgcccgggacaggagcauagcucucgccuuccucgcgacuggaggcguacucgucuucuuagccacgaacgugcacgcauaa

SEQ ID NO: 2471 - RNA, 2037 nt, Artificial Sequence
  derived and/or modified CDS sequence (opt11) from DENV-3 Consensus__SSopt-pr(D104A)MEdelstem_TM,(F108S)-JEV
augaaacgaaagaaaacaagccuaugccucaugaugauccuccccgcggcccuugcauuccaccuaaccucgcgcgacggagagcccaggaugauaguaggcaaaaacgaaagaggcaaaagccuacuauucaaaaccgccucaggcaucaacaugugcacacugauagccauggaccuaggagaaaugugcgaugacacaguaacauacaaaugcccccacauaacagaagucgaaccagaagauaucgacuguuggugcaaccucacaagcacauggguaaccuacggaaccugcaaccaagccggcgaacaccgacgugccaaacgcagcgucgcccuagcaccacacguaggcaugggccucgacacacgcacacaaacauggaugagcgcagagggggcguggagacaagucgaaaaaguagaaacaugggcccucagacacccgggcuucacaauccuagcgcuauuccuggcgcacuauauagggaccucgcucacccagaaggucgucaucuucauccuacucaugcuggucacccccuccaugaccaugcgcugcgugggagucgggaacagagacuucguggaaggguuaagcggggccacaugggucgacguaguccuggagcacggagggugcguaacgaccauggccaaaaacaaacccacccuagacaucgaacuacagaaaaccgaagcaacccaacuggcaacacuccgaaaacuaugcaucgaagguaaaaucaccaacauaaccacggauagccgaugcccaacucagggcgaggcaacacuucccgaggaacaagaccaaaacuacguaugcaaacacaccuacguagacagaggauggggcaacggcugcggacugagcggaaagggaucccugguaacaugcgccaaauuccaaugccuugaacccauagaaggaaaggucguccaguacgaaaaccucaaauauaccguaaucauaacaguccacacaggagaccaacaccaagucggcaaugaaacgcaaggagucacggcagaaaucacaccccaagccuccaccacggaagcaauacuccccgaguacgguacacugggccucgagugcagcccacgcaccggccuagacuucaacgagaugauccuccugaccaugaaaaacaaagcguggaugguccaucggcaaugguucuucgacuuaccacucccguggaccucaggggccaccaccgagacccccaccuggaaccggaaagagcuccuagucacauucaaaaacgcccacgcaaagaaacaagaagucgugguacuaggcucccaagaaggggcaaugcacaccgcauuaacaggcgcaaccgaaauccaaaacucgggagggaccucgauauucgcaggccaccucaaaugccgucucaaaauggacaagcuagaacuaaaaggcaugagcuacgccaugugcacaaacacauucguacuaaagaaagaagucagcgagacacaacacggcacaauccucauaaaaguagaguauaaaggcgaagacguacccugcaaaauaccauucagcacagaggacggccaaggaaaggcccacaaugggcgccucauaacagcuaacccaguaguaacgaagaaagaggagcccgucaacaucgaagcagaaccacccuucggcgaaagcaacaucgucaucggaaucggagacaacgcccuaaaaaucaacugguacaagaaagggaguacacuuggcaaagcauucucgacaacacuuaagggcgcacaaagacucgcagcacugggagacacagcaugggacuucggcagcaucggcggcgucuucaacuccauaggaagggcuguccaccaaguauucggcggcgccuuccgcacgcuauucggaggaaugagcuggaucacgcaaggacuaaugggagcacuccuccuauggaugggaguaaacgcgagagacagauccauagcccuagccuuccuagcgaccggaggcguacucguauucuuagcaaccaacguccacgcauaa

SEQ ID NO: 2472 - RNA, 2037 nt, Artificial Sequence
  derived and/or modified CDS sequence (opt11) from DENV-3 Consensus__SSopt-pr(D104A)MEdelstem_TM,(R186L,A265T)-JEV
augaaacgcaagaaaacgucccuaugccuaaugaugaucuuaccugcagcccuagcauuccaucucacaucacgcgacggcgagccccgaaugaucgucggcaaaaacgaaagaggaaaaagccuccucuucaaaacagccuccggaauaaacaugugcacacucaucgccauggaccucggugagaugugcgacgacaccguaaccuacaaaugcccccauaucacagaagucgaaccggaagauaucgacugcuggugcaaccucaccaguaccugggugacauacggaaccugcaaccaagcuggagaacacagacgagcgaaacgaagcguggcccuugccccacacgugggcaugggucuagacacacgaacgcaaaccuggaugagcgcggaaggagcauggcgccaggucgagaaagucgagacaugggcacuccgacacccuggcuucacuauacuagcacuauuucucgcacacuacaucggaaccucacuaacacaaaaagucguaaucuucauccuacucaugcucguaacccccagcaugaccaugcgcugcguuggagucggaaacagggacuuuguugaaggacucagcggagcaacguggguagacgugguauuagaacacggcggaugcguuaccacaauggcgaaaaacaaaccgacacuagacauagagcugcagaaaaccgaagccacacaacucgcaacccuacgaaaacuaugcaucgaagggaaaaucacaaacaucaccacagacuccaggugcccuacacaaggcgaagcaacccucccagaggaacaagaccaaaacuacguaugcaaacacacauacguggaccggggcuggggaaacgguugcggccucuucggaaaaggaagccuggucacaugcgccaaguuccaaugccuagaacccauagaagggaaaguaguccaauacgaaaacuugaaauacacagucauaauuacaguacacacaggcgaccagcaccaagucggcaacgaaacccaaggagucacagccgaaaucacaccccaggcauccaccacagaagcgauacuacccgaauacggaaccuuaggacuagaaugcagcccacucaccggccuagacuucaacgagaugauacuccuaaccaugaaaaauaaagcauggaugguucaucgccaaugguucuucgaccuaccccucccauggacgaguggggcaacuaccgaaacgccgacuuggaaccgaaaagagcuacuggucacauucaagaacgcucacgccaaaaagcaagaagugguuguacugggcucgcaagaaggcgcaaugcacacagcccugacgggcaccaccgagauacagaacucaggcggaaccuccauauucgccggccaccucaagugccgauugaaaauggacaagcucgaacuaaaaggcaugaguuacgccaugugcacaaacacguucgugcuuaagaaagaggucuccgaaacacagcacggcacaauccuaaucaaagucgaguacaaaggcgaggacguucccugcaaaauacccuucagcacagaagauggccagggcaaagcccacaacggccgacuaaucaccgccaaccccguaguaaccaaaaaggaagaacccguuaacauugaagcagaaccaccauucggcgaauccaacauaguaaucggcauaggagacaacgcccucaaaaucaacugguacaagaaaggaucaacgcucgggaaagccuucucgaccacucucaaaggcgcccaacgccuagcggcacuaggcgacacagccugggacuucggcuccauuggcggggucuuuaacucuauaggacgcgcgguccaucaaguguucggcggagcauucaggacacuauucgggggcaugagcuggaucacacaaggccucaugggugcccuccugcucuggaugggaguuaacgccagagaccgcagcaucgcacucgcuuuccucgccaccggcggcguacucgucuuccucgccacaaauguacacgcguaa

SEQ ID NO: 2473 - RNA, 2037 nt, Artificial Sequence
  derived and/or modified CDS sequence (opt11) from DENV-3 Consensus__SSopt-pr(D104A)MEdelstem_TM,(F108S,R186L,A265T)-JEV
augaaacgcaaaaagacgagccugugccuaaugaugauccuccccgcagcccuugccuuccaccugacaucccgcgacggagaacccagaaugauagucgggaaaaaugaaagaggcaagucccuacucuucaaaaccgcaucagggauaaacaugugcacgcucaucgccauggaccugggagaaaugugcgacgacacaguaaccuacaaaugcccccacaucacagaaguggaaccagaagacauagacugcuggugcaaucugacauccaccugggucaccuacggaacgugcaaccaggcaggcgaacacagacgcgcaaaacgguccgucgcauuggcaccccacguaggaaugggccuggacacgcgaacacaaacuuggaugagcgcggagggagccuggagacaggucgagaaagucgaaacaugggcacuuagacacccaggcuucaccauacucgcacuauuccucgcccacuauauagggaccagccucacacaaaaggugguaaucuucauccugcucaugcucguaaccccaagcaugaccaugcgcugcgucggcguaggcaacagagacuucguggaaggccugagcggggcaacauggguggacguagucuuagaacacggcggaugcgugaccacaauggccaaaaacaagccgacccuagacaucgaacugcaaaagacagaggccacgcaacuggcaacgcucagaaagcuaugcauagaaggcaaaauaacaaacaucacgacagacaguaggugcccgacccaaggcgaagccacucuaccggaagaacaagaccaaaacuacgugugcaagcacacauacguagaccggggcuggggaaauggaugcggccucagcgggaaaggaagccucgucacaugcgcaaaauuccagugccuagaaccaauagaaggcaaggugguccaguacgagaaccuaaaauacaccguaaucauaacaguacacacgggcgaccaacaccagguaggcaaugaaacgcaaggagucacagccgaaaucacaccacaagcaucgaccacagaagccauccuacccgaguacggaacacucggacuugagugcagcccauuaacaggccucgacuucaacgaaaugauccuacugaccaugaaaaacaaagcguggaugguccaccgacaaugguucuucgaccuaccgcuaccauggacaaguggggcaacgaccgaaaccccaacauggaacaggaaagaacuacuggucacguucaagaacgcacacgcuaaaaagcaagaaguaguaguccugggcucgcaggagggcgcaaugcacaccgcgcucacaggaaccacagaaauccaaaacucgggagggaccucaaucuucgcggggcacuugaaaugccgccugaaaauggacaaacucgagcuuaagggcauguccuacgcaaugugcacaaauacguuuguccucaagaaagaaguaucagaaacgcaacacggaacaauucuaaucaaagucgaauacaaaggggaagacguacccuguaaaauccccuucagcacagaagacggacaaggaaaagcgcacaacgggcgcuuaauaacagccaacccaguagucaccaaaaaggaagaacccgucaacauugaagcagaaccacccuuuggcgagagcaacaucgugauaggaaucggagacaacgcacuaaaaauaaacugguacaagaaaggaagcacacucggaaaagcauucucaacaacacucaaaggagcccaacggcuagcggcccuuggcgacacagcaugggacuucggaaguauaggcggcguauucaacuccaucggccgagcgguccaccaaguguucggaggcgcauucaggacucuauucgggggcaugagcuggaucacacaaggccuaaugggcgcccuauugcucuggaugggagucaacgccagggaucgaagcauagcgcuggcauuccucgcaaccggaggcguacugguguuccuggcaaccaacguccaugcauaa

SEQ ID NO: 2474 - RNA, 2037 nt, Artificial Sequence
  derived and/or modified CDS sequence (opt11) from DENV-3 Consensus__SSopt-prMEdelstem_TM,(H259N)-JEV
augaaacgcaagaaaaccagccugugcuuaaugaugauauuaccagcggcccuagcauuccaccugacaucacgcgacggcgaacccaggaugauagucggcaaaaacgagcgaggaaaaagccuccucuucaaaaccgccuccggaauaaacaugugcacccuaaucgcuauggaccucggcgagaugugugacgacaccguaaccuacaaaugcccucauauuacagaaguagaaccggaagacaucgacugcuggugcaaccucacaagcaccuggguaaccuacggaaccugcaaccaagccggcgagcacagacgggacaaaagauccgucgcgcuagcuccccacgucggcaugggacuagacacacgcacccaaacauggaugagcgccgagggagccuggcgccaaguugagaaaguagaaacaugggcucucaggcauccaggcuucacaauccucgcacucuuccucgcacacuacaucggaaccucgcuaacacaaaaagucguaaucuucauccuccuuaugcuaguaaccccgagcaugaccaugcgcugcgugggcgucggaaacagagacuucguagagggccuaagcggagccacguggguagacguaguccucgaacacggcggaugcguuacuacaauggccaaaaauaaaccaacccucgacauagaacuccagaaaaccgaagcaacccaacuggcaacacuacgcaaacuaugcaucgagggcaaaauaacaaacaucaccaccgacuccagaugccccacucaaggcgaagcaacacugccagaagaacaagaucaaaacuacguaugcaaacacacauacguagacagaggcuggggcaacggcugcggacuguucggcaaaggaagccucguaacaugcgcaaaauuccagugccucgagcccauagaaggcaaagucguccaauacgagaaccugaaauacacagucaucaucaccguacacacaggcgaccaacaccaaguaggaaaugaaacgcaaggagucacagccgaaauaacgccccaggccuccacaacggaagcgauccuuccagaauacgggacauuaggcuuagaauguucgcccagaaccggccuagacuucaacgaaaugauccuacugaccaugaaaaacaaagccuggaugguccacagacaaugguucuucgaccuaccacucccauggacaagcggagccaccaccgagaccccaaccuggaacaggaaggaacuccuagucaccuucaaaaaugcccacgcgaagaaacaggaggucguaguccuaggcucccaagagggcgccaugaacacagcguuaacaggugccacagaaauccaaaauucaggcggaaccucaaucuucgccggccaccucaaaugucgacucaaaauggacaaacucgaacuaaaaggaauguccuacgccaugugcacaaacacauucgugcucaagaaagaagucucagaaacccagcacggcacaauacuuauaaaaguagaauacaagggugaggacguacccugcaaaaucccauucagcacagaagacggccaaggaaaagcacacaauggacgacugauaacggcaaacccagugguaacaaagaaagaagaaccagucaacauagaagccgaacccccuuucggcgaaaguaauaucgugaucggaaucggagacaacgccuuaaaaauaaacugguacaagaaaggauccacacuaggcaaagcauucucgaccacgcucaaaggcgcacaacgccucgccgcccugggagacaccgcaugggacuucggaaguauaggcggagucuucaacucgaucgggcgcgccguacaccaaguauucggcggagcauucagaacccuuuucggagguauguccuggaucacacaaggacuaaugggcgcacuccuacuauggaugggggucaacgccagagaccgcagcauagcacucgccuuccuugcaaccggcgggguacucgucuuccuagccacaaacguccacgcauaa

SEQ ID NO: 2475 - RNA, 2037 nt, Artificial Sequence
  derived and/or modified CDS sequence (opt11) from DENV-3 Consensus__SSopt-prMEdelstem_TM,(R186L,A265T)-JEV
augaaacgcaagaaaaccucacuaugccucaugaugauacuacccgccgcacucgcauuccaccugaccagccgagacggagagcccagaaugaucgucggcaaaaacgaaagaggcaaaagccuacucuucaaaaccgcaucaggaaucaacaugugcacacucaucgccauggacuuaggugaaaugugugacgacacggugaccuacaaaugcccccauaucaccgaagucgaacccgaagacauagacugcuggugcaaccucacaaguaccugggugaccuacgguaccugcaaccaagcaggcgaacaccgacgagacaaaagaagcguagcccucgccccucacgucggcaugggacucgacacccgcacccaaacauggaugagcgcagaaggggccuggcgccaaguagagaaaguagaaacaugggcccucagacacccaggcuucaccauccucgcccucuuccucgcccacuacaucggaaccucgcuaacacaaaaagucguaaucuucauacuccuaaugcuaguuacccccagcaugacuaugcgaugcguaggggucggaaaccgcgacuucgucgagggccuaagcggagccacgugggucgacgugguccuagaacacggaggaugcguaacaaccauggcgaaaaacaaaccgacccucgacaucgaacuacagaaaacagaagccacacaacuggccacauuaagaaaacuaugcauagaagggaaaauaaccaacaucaccaccgacucacgcugcccaacacaaggcgaagcaacccuacccgaagaacaagaccaaaacuauguauguaaacacacauacguagacagaggcuggggaaacggaugcggccucuucgguaaaggaagccuaguuacaugcgcaaaguuccaaugccucgaaccgaucgaagggaaaguaguacaauacgaaaaccucaaauacaccgucauaauaaccgugcacacaggcgaccaacaucaagucggcaacgaaacccaaggaguaacagccgaaauaacaccccaagcaagcacaacagaggcgauccucccagaguacggcacacuaggccucgaaugcagcccucucaccggacuagacuucaacgagaugauacucuuaaccaugaaaaacaaagcguggaugguacaccgacaaugguuuuucgaccucccgcuuccauggaccagcggcgcaacaaccgaaacgccaacguggaacagaaaagaacuccuaguaaccuucaaaaacgcacacgccaaaaagcaagagguagugguacugggcucacaagaaggcgcaaugcacaccgcccucacggggacgaccgagauccaaaacucgggaggcacauccaucuucgccggccacuuaaaaugccgccuaaaaauggacaaacucgagcuaaagggcaugagcuacgccaugugcacaaacacauucguacucaagaaggaaguuucggaaacccaacacggcacuauccucaucaaagucgaauacaaaggagaagaugugccgugcaaaauacccuuuagcacagaagacggacaaggcaaagcacacaacggccgcuuaaucacugcaaaccccguaguaacaaagaaagaggaacccgucaacaucgaagcggaaccaccauucggcgaaagcaacaucgucaucggaaucggagacaacgcacuaaaaaucaacugguacaagaaagguuccacacucggaaaagcauucuccacaacccucaaaggcgcccaaagacucgcagcccuaggcgacaccgcaugggacuucggguccauaggcggaguguucaacuccauagggcgagcgguacaccaaguauuuggcggcgccuuccgaacacucuucggaggaauguccuggaucacacaaggccucaugggagcacuacuccuuuggaugggaguaaacgcccgagacaggucaauagcacucgcauuccuggccacgggcggaguacucguauuccuugcgaccaacguacacgcauaa

SEQ ID NO: 2476 - RNA, 2016 nt, Artificial Sequence
  derived and/or modified CDS sequence (opt11) from DENV-3 Consensus__SSopt-prMEdelstem_TM,del101-107,(R99P,F108N)-JEV
augaaacgaaagaaaacaucgcuaugccucaugaugauccuacccgcagcacuagccuuccaccucacauccagagacggagaaccccgcaugauuguaggcaaaaacgaacgcggaaaaucacuucuauucaaaaccgcaagcgguaucaacaugugcacucuaaucgccauggaucucggggaaaugugugacgacacaguaaccuacaaaugcccacacauaaccgaaguagaacccgaggacauagacugcuggugcaaccucacaagcaccugggucacguacggaaccugcaaccaagcuggagaacacagacgcgacaagcgcucagucgcacuagcaccccacgucggaaugggacuagacacuaggacccaaaccuggaugucggccgaaggagcauggagacaagucgaaaaaguagaaacuugggcacuccgccacccaggguucacaauacuagcacuauuccuagcccacuacauaggcacaucacuaacccaaaaagucgucauauuuauccuccugaugcuagucaccccaagcaugacaaugcgcugcgucgggguaggaaaccgcgacuucguagaagggcucuccggcgccacaugggucgacgucguacuagagcacggaggcugcgucacaaccauggccaaaaacaaacccacgcuagacaucgaacuacagaaaacugaagcgacccagcuagcaacucugcgcaaacucugcauagagggaaaaaucacuaacauuaccaccgacucccgcugcccaacgcaaggagaagccacccugcccgaggaacaggaccaaaacuacguaugcaaacacaccuacguagacccagguaacgggaaaggcagccuaguaaccugcgcaaaauuccaaugccuggaacccauagaagggaaagucguccaauacgaaaaccuaaaauacacaguaauaauaacaguacacacaggcgaccaacaccaagugggaaacgaaacccaaggggucacggccgaaaucacgccccaagcaucaaccaccgaagcgauacuacccgaauacgguacccuaggccuagaaugcagcccacgcaccggccucgacuucaacgaaaugauacuucugaccaugaaaaacaaagcguggaugguccaccggcaaugguucuucgaccucccacuccccuggacauccggcgccaccaccgagacacccaccuggaacagaaaagaacuccucguaacuuucaagaacgcucacgccaaaaagcaagagguaguaguccucggcagucaagaaggcgcaaugcacaccgcacuaacgggagcaaccgaaauccaaaacagcggaggcacgucgaucuucgcaggccaccucaaaugccgccucaaaauggacaagcucgaacuaaaaggaaugagcuacgccaugugcacgaacacauucguacuaaagaaagagguaucggaaacccaacauggcacaauccugaucaagguggaguacaagggcgaagacguacccugcaaaauacccuucuccaccgaagacggacaaggcaaagcccacaacggccgccucaucacggccaaccccguaguuaccaagaaagaagaaccagugaacauagaggccgaaccacccuucggagaaagcaauauaguaaucgggaucggagacaacgccuugaaaaucaacugguacaagaaaggaagcacccucggaaaagcauucuccaccacgcucaaaggcgcacaaagacucgcagcacugggcgacaccgccugggacuucggcaguaucggcggggucuucaacagcaucggucgcgccguccaccaaguauucggaggagccuuccgaacucuguucgggggaaugagcuggauaacccaaggccucaugggagcccuccuccuauggaugggugugaacgcccgcgacagaagcaucgcccuagcauuccuagcaaccggaggcguccuugucuuccucgccacaaacguacacgcguaa

SEQ ID NO: 2477 - RNA, 3081 nt, Artificial Sequence
  derived and/or modified CDS sequence (opt11) from DENV-3 Consensus__SSc-prME-NS1
augacaucauugugccucaugaugauccugcccgccgcacucgcauuccaccuuaccucgcgggacggcgagcccagaaugauagucggcaaaaacgaaaggggaaaaucucuccuguucaaaaccgcgagcggaauaaacaugugcacacuaauagccauggacuuaggagaaaugugcgacgacacugugaccuacaaaugcccccacaucacggaagucgaaccggaagacauagacugcuggugcaaucucacuagcaccuggguaaccuacggaacgugcaaucaagcuggugaacacaggcgagacaaaagaagcguagcacuggccccacacgucgggauggggcuagacacaagaacccaaacuuggaugagugcagaaggggccuggcgacaagucgaaaaagucgagacgugggcacucaggcacccgggauucaccauccucgcacucuuccuagcccacuacaucgggaccucccuuacccaaaaagucguaauauucauacuauuaaugcuagugaccccguccaugacaaugcgcugugucggagucgguaauagagacuucgucgagggauugagcggggcaacguggguagacgucguucucgagcacggcggaugugucaccacgauggcaaagaacaaacccacccuugauauagaauuacaaaagacggaagccacccaauuagcaacacucagaaagcucugcauugaaggaaagauaacgaacaucacaacugacuccagaugcccaacccaaggcgaagcaacgcugccggaagaacaggaccaaaacuacgugugcaaacacaccuacguggacaggggcuggggcaacggaugcggacuauucggaaaaggaagccucgucacuugcgcaaaguuccaaugccucgaacccauagaagggaaagucguacaguacgaaaaccucaaauacacuguaauuaucacaguccauacgggagaccagcaccaagucggcaacgaaacacagggugucaccgccgaaauaacaccacaagcauccacaacggaggcaauacugcccgaauacgggacccuagggcuggagugcagcccgcgcacgggccucgacuucaacgaaaugauacuccucaccaugaagaauaaagcauggaugguccacaggcaaugguucuucgaccugccacugccguggaccagcggggcgaccaccgaaaccccaaccuggaaucggaaagagcuucuaguuacuuucaaaaacgcccacgcaaagaaacaagaagucguaguccugggaucgcaagaaggcgcaaugcacaccgcacuuacgggcgcaaccgagauccaaaacuccgggggaaccuccaucuucgcaggacaccuaaaaugccgccucaaaauggauaaacucgaacucaaaggcauguccuacgccaugugcacaaauacguuuguccuaaagaaagaagucucggaaacgcaacacggaaccauacuuaucaaaguagaauacaagggcgaagacgucccaugcaaaauccccuucagcaccgaagacggccagggaaaggcacacaauggccgccuaauaaccgcaaaccccguaguuacgaaaaaggaagaaccagugaacauagaagcugaacccccauucggggaauccaauauaguaaucggcaucggcgacaacgcccugaaaaucaacugguacaagaaagggaguucaauaggaaaaauguucgaagcaacagcacggggcgcccgaagaauggcaauccuaggcgacaccgcaugggacuuuggaucuguaggaggcguucuaaauagccuaggcaagaugguccaccaaaucuucggaagugcauacacagcccuguucagcggcgucucauggguuaugaagauaggcauaggcgugcuucucaccuggauaggauugaacagcaaaaacaccagcaugagcuucuccugcaucgcaaucggaauaauaacccuguaccuaggagccgucguccaagccgauaugggaugugugaucaacuggaaagggaaagaacucaaaugcggcagcggaaucuucgucacgaacgagguccacacauggaccgagcaauauaaauuccaagcagacucccccaagcgccuagcgaccgcaaucgccggagccugggaaaacggcgugugcggaaucagaucgacaacgaggauggaaaaccuccuauggaaacaaaucgcaaacgaacucaacuauauccuaugggaaaacaacaucaaauugacaguaguggucggcgacaucauaggcgugcuagaacaagggaaacgaacccuaaccccacaacccauggagcucaaauacagcuggaagacaugggggaaagcaaagaucgucacagccgaaacacagaacagcucguucauaaucgauggaccaaacacaccagaaugcccaucaguaagcagggccuggaacguaugggaagucgaggacuacggcuucggcgucuucacaaccaacauauggcuaaagcuaagagagguguacacccagcuaugcgaccacagacucaugagugcggcagucaaagacgagagagcuguccacgccgacaugggcuacuggaucgaaucacagaaaaacggaagcuggaaacuagagaaggcaagccuaauagaggugaaaacgugcaccuggccgaaaagccacacgcucuggagcaauggcgugcucgaaucagacaugaucauccccaaaagccucgcaggccccaucucccaacauaaccaccgacccgguuaccacacccaaaccgcaggcccguggcaccugggcaagcuggaacucgacuucaacuacugugaggggaccaccguuguaauaacagaaaacugcggaacccggggcccgagcuuacgaacgacaacagucagcggcaaacucauucaugaauggugcugcagauccugcacacuucccccacuaagauacaugggagaggacggaugcugguacgggauggaaauaagacccauaagcgagaaagaagaaaacauggucaagagucuggucagcgcauaa

SEQ ID NO: 2478 - RNA, 1824 nt, Artificial Sequence
  derived and/or modified CDS sequence (opt11) from DENV-3 Consensus__SSm-EdelTM-linker-ferritin
augacacaaaaagucguuauauucauccuacucaugcuagugacaccaucgaugaccaugcgcugcguaggcgugggaaaccgggauuucguagagggccuauccggagcaacauggguagacguaguacucgaacacggcgggugcgugacaacaauggccaagaacaaacccaccuuagacauagagcuccaaaaaacagaagccacacagcucgcaacgcucaggaaacuaugcaucgaagggaaaaucacuaacaucacuaccgacagccgaugcccaacccagggcgaggcaacccuaccagaagaacaagaccaaaacuacgucugcaaacacacauacgucgacagaggcuggggcaacggcuguggacuauucggaaaaggcucccuggucaccugcgcaaaauuccagugccuagaaccaaucgaagggaaagucguacaauacgaaaaccucaaauacacagucaucaucacgguacauacaggagaccaacaccaagucgggaacgaaacccaaggagucacggccgaaaucacaccccaagccagcaccaccgaagcgauacuacccgaauacggcacacucggccuugaaugcagcccccggacaggccuagacuucaacgaaaugauacuacucaccaugaaaaacaaagccuggaugguccacagacaaugguucuucgaccugccccucccauggacguccggcgcaacgaccgaaacacccacguggaaccgcaaagagcuacucguaacauucaaaaacgcccacgccaaaaaacaagaagucguaguacuuggaucacaagaaggagcaaugcacaccgcacucaccggcgccacagagauacaaaacucaggcggaaccucaaucuuugccggccaccucaaaugccgccucaaaauggauaaacucgaacucaaaggcauguccuacgcaaugugcaccaacacuuucguccucaaaaaagaggucucagaaacccaacacggaaccauccuaaucaaaguagaauacaaaggcgaagacgugccaugcaaaauacccuucagcacagaagacggccaaggcaaagcccacaacggccgacuaaucaccgcaaaccccguagucacgaaaaaagaagagcccgucaacauagaagcggaaccacccuucggcgaaagcaacaucgucaucggcaucggcgacaacgccuuaaaaaucaacugguacaaaaaaggcucauccauaggaaaaauguucgaagccacagccaggggcgcgcgccgcauggcaauacucggcgacaccgcaugggacuucggaagcucagggggugacaucaucaaacuccugaacgaacaagucaacaaagaaaugcaauccagcaaccuauacauguccaugagcuccuggugcuacacccacagccucgacggagccggacuauuccucuucgaccacgccgcagaagaauacgaacacgccaaaaaacucaucaucuuccucaacgaaaacaacguccccguacaacuaacauccauaucggcccccgaacacaaauucgaaggccucacacaaaucuuccagaaagcauacgaacacgagcagcacaucagcgaauccauaaacaacauagucgaccacgccaucaaaagcaaggaccacgccacauucaacuuccuacaaugguacgucgccgaacagcacgaagaggaagugcuauucaaagacauccuggacaagauagaacucaucggcaacgaaaaccacggacuuuaucucgccgaccaauacguaaaaggcaucgcaaaguccagaaaauccuga

SEQ ID NO: 2479 - RNA, 1821 nt, Artificial Sequence
  derived and/or modified CDS sequence (opt11) from DENV-3 Consensus__SStPA-WHbcAg-linker-EdelTM
auggacgccaugaaacggggacucugcugcguacuucugcucugcggagccguuuucguagacuccguaacagggauggacauagaccccuacaaagaguucggcucauccuaccaacuccuaaacuuccuaccacucgacuucuuccccgaccucaacgcccuagucgacaccgccaccgcacucuacgaagaagaacuaaccgggcgcgaacacugcagcccccaccacaccgccaucaggcaggcgcucguaugcugggacgaacuaacaaaacucaucgcauggaugucaagcaacaucaccucggaacaaguaagaaccauaauagucaaccacguaaacgacaccuggggacugaaagucagacagucacugugguuccaccucucaugccucacuuucggacagcacacuguacaagaguuccucgucagcuucggcguauggaucagaacccccgcacccuaucgaccacccaacgcccccaucuuauccacacugcccgaacacacaguaaucugcggaggcggcggcagcgggggcggcgggaugcgcuguguaggcgucggcaacagggacuucguagaaggccuaagcggagccacauggguagacguaguccuagaacacgggggaugcguaaccacaauggccaaaaacaagccgacccucgacaucgaacuacagaaaacagaagccacccaacucgccacacuccgcaaacuaugcauagaaggaaaaaucaccaacaucaccaccgacucgcgcugccccacccaaggcgaagccacacucccagaagaacaagaccaaaacuacguaugcaagcacaccuacguagaccgaggcuggggcaacggcugcggcuuauuugguaaggguagccuaguaacaugcgccaaauuccaaugccucgaaccgauagaaggaaaaguaguacaauacgaaaaccucaaauacaccguaauaaucacaguccacaccggcgaccaacaccaggucgggaacgaaacccaaggagucacagccgaaauaaccccacaggcauccaccacagaagcaauacuacccgaauacggaacacugggacucgaaugcagccccagaaccggucuagacuucaacgaaaugauacuacuaaccaugaaaaacaaagccuggaugguccacagacaaugguucuucgaccucccccucccauggacaagcggcgccacaacagagacacccacauggaacagaaaagaacuccuagucaccuucaagaacgcgcacgcaaagaaacaagaaguagucguucuaggaucccaagagggcgccaugcacaccgcccugaccggagccaccgaaauccagaacucaggaggcacauccauuuuugccggacaccugaaaugccgacuaaaaauggacaaacucgaacucaaaggcaugucuuacgccaugugcacaaacacauucguccuaaagaaagaagucuccgaaacccaacacggcaccauccucaucaaagucgaguacaaaggagaagacguaccaugcaaaaucccauucagcacagaagauggucaaggcaaagcccacaacggacgccuuauaaccgccaaccccgucgucaccaagaaagaggagcccgucaacaucgaagccgaaccacccuucggcgaaaguaacauagucaucggaauaggcgacaacgcccuaaaaauaaacugguacaagaaaggaagcucaaucggcaaaauguucgaagcaacagccaggggcgcgcgcagaauggcaauccucggcgacacagccugggacuucgggagcuag

SEQ ID NO: 2480 - RNA, 2248 nt, Artificial Sequence
  mRNA product Design1 comprising derived and/or modified sequence from DENV-1 CYD23__SSc-prME (CDS opt1)
gggagaaagcuuaccaugagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2481 - RNA, 2248 nt, Artificial Sequence
  mRNA product Design1 comprising derived and/or modified sequence from DENV-1 CYD23__SSc-prME(F108S) (CDS opt1)
gggagaaagcuuaccaugagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguccggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2482 - RNA, 2248 nt, Artificial Sequence
  mRNA product Design1 comprising derived and/or modified sequence from DENV-1 CYD23__SSc-prMEdelstem_TM-JEV (CDS opt1)
gggagaaagcuuaccaugagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2483 - RNA, 2596 nt, Artificial Sequence
  mRNA product Design1 comprising derived and/or modified sequence from DENV-1 CYD23__C-P2A-SSc-prME (CDS opt1)
gggagaaagcuuaccaugaacaaccagcgcaagaagaccgcccggccgagcuucaacaugcugaagcgcgcccggaaccgcguguccaccgucagccagcucgcgaagcgguucuccaagggccugcugagcgggcagggccccaugaagcucgugauggccuucaucgccuuccugcgcuuccuggccaucccgcccacggccgggauccucgcgcgguggggcuccuucaagaagaacggggccaucaaggugcugcgcggcuucaagaaggagaucagcaacaugcugaacaucaugaaccggcgccggaagaacuucgaccugcucaagcuggccggcgacguggagagcaaccccgggccgagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2484 - RNA, 2260 nt, Artificial Sequence
  mRNA product Design1 comprising derived and/or modified sequence from DENV-1 CYD23__SSopt-prME(F108S)  (CDS opt1)
gggagaaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguccggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2485 - RNA, 2260 nt, Artificial Sequence
  mRNA product Design1 comprising derived and/or modified sequence from DENV-1 CYD23__SSopt-prME(F96H) (CDS opt1)
gggagaaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcacccacguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2486 - RNA, 2260 nt, Artificial Sequence
  mRNA product Design1 comprising derived and/or modified sequence from DENV-1 CYD23__SSopt-prME(S186F) (CDS opt1)
gggagaaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcuucccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2487 - RNA, 2260 nt, Artificial Sequence
  mRNA product Design1 comprising derived and/or modified sequence from DENV-1 CYD23__SSopt-prME(R188L) (CDS opt1)
gggagaaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccugacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2488 - RNA, 2260 nt, Artificial Sequence
  mRNA product Design1 comprising derived and/or modified sequence from DENV-1 CYD23__SSopt-pr(D104A)MEdelstem_TM,(F108S)-JEV (CDS opt1)
gggagaaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgccaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcugagcggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2489 - RNA, 2260 nt, Artificial Sequence
  mRNA product Design1 comprising derived and/or modified sequence from DENV-1 CYD23__SSopt-prMEdelstem_TM,(H261N)-JEV (CDS opt1)
gggagaaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugaacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2490 - RNA, 2260 nt, Artificial Sequence
  mRNA product Design1 comprising derived and/or modified sequence from DENV-1 CYD23__SSopt-prMEdelstem_TM,(R188L,A267T)-JEV (CDS opt1)
gggagaaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccugacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacggggaccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2491 - RNA, 2248 nt, Artificial Sequence
  mRNA product Design1 comprising derived and/or modified sequence from DENV-2 CYD2-T__SSc-prME (CDS opt1)
gggagaaagcuuaccaugagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2492 - RNA, 2248 nt, Artificial Sequence
  mRNA product Design1 comprising derived and/or modified sequence from DENV-2 CYD2-T__SSc-prME(F108S) (CDS opt1)
gggagaaagcuuaccaugagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuccgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2493 - RNA, 2248 nt, Artificial Sequence
  mRNA product Design1 comprising derived and/or modified sequence from DENV-2 CYD2-T__SSc-prMEdelstem_TM-JEV (CDS opt1)
gggagaaagcuuaccaugagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2494 - RNA, 1549 nt, Artificial Sequence
  mRNA product Design1 comprising derived and/or modified sequence from DENV-2 CYD2-T__SSm-EdelTM (CDS opt1)
gggagaaagcuuaccauguuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2495 - RNA, 2596 nt, Artificial Sequence
  mRNA product Design1 comprising derived and/or modified sequence from DENV-2 CYD2-T__C-P2A-SSc-prME (CDS opt1)
gggagaaagcuuaccaugaacaaccagcgcaagaaggccaagaacaccccguucaacaugcugaagcgggagcgcaaccgggugagcaccguccagcagcucacgaagcgcuucucccugggcaugcugcaggggcggggcccccucaagcuguucauggcccugguggcguuccuccgcuuccugaccaucccgcccaccgccgggauccugaagcgguggggcaccaucaagaagagcaaggccaucaacgugcuccgcggguuccggaaggagaucggccgcaugcugaacauccugaaccggcgccggcgcaacuucgaccugcucaagcuggccggcgacguggagagcaaccccgggccgagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2496 - RNA, 2260 nt, Artificial Sequence
  mRNA product Design1 comprising derived and/or modified sequence from DENV-2 CYD2-T__SSopt-prME(F108S)  (CDS opt1)
gggagaaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuccgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2497 - RNA, 2260 nt, Artificial Sequence
  mRNA product Design1 comprising derived and/or modified sequence from DENV-2 CYD2-T__SSopt-prME(M96H) (CDS opt1)
gggagaaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacucccacguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2498 - RNA, 2260 nt, Artificial Sequence
  mRNA product Design1 comprising derived and/or modified sequence from DENV-2 CYD2-T__SSopt-prME(S186F) (CDS opt1)
gggagaaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuucccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2499 - RNA, 2260 nt, Artificial Sequence
  mRNA product Design1 comprising derived and/or modified sequence from DENV-2 CYD2-T__SSopt-prME(R188L) (CDS opt1)
gggagaaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcugacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2500 - RNA, 2260 nt, Artificial Sequence
  mRNA product Design1 comprising derived and/or modified sequence from DENV-2 CYD2-T__SSopt-pr(D104A)MEdelstem_TM,(F108S)-JEV (CDS opt1)
gggagaaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgccaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucagcgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2501 - RNA, 2260 nt, Artificial Sequence
  mRNA product Design1 comprising derived and/or modified sequence from DENV-2 CYD2-T__SSopt-prMEdelstem_TM,(H261N)-JEV (CDS opt1)
gggagaaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugaacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2502 - RNA, 2260 nt, Artificial Sequence
  mRNA product Design1 comprising derived and/or modified sequence from DENV-2 CYD2-T__SSopt-prMEdelstem_TM,(R188L,A267T)-JEV (CDS opt1)
gggagaaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcugacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcaccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2503 - RNA, 2248 nt, Artificial Sequence
  mRNA product Design1 comprising derived and/or modified sequence from DENV-4 Consensus__SSc-prME (CDS opt1)
gggagaaagcuuaccaugagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2504 - RNA, 2248 nt, Artificial Sequence
  mRNA product Design1 comprising derived and/or modified sequence from DENV-4 Consensus__SSc-prME(F108S) (CDS opt1)
gggagaaagcuuaccaugagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguccgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2505 - RNA, 2248 nt, Artificial Sequence
  mRNA product Design1 comprising derived and/or modified sequence from DENV-4 Consensus__SSc-prMEdelstem_TM-JEV (CDS opt1)
gggagaaagcuuaccaugagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2506 - RNA, 1549 nt, Artificial Sequence
  mRNA product Design1 comprising derived and/or modified sequence from DENV-4 Consensus__SSm-EdelTM (CDS opt1)
gggagaaagcuuaccaugauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2507 - RNA, 2593 nt, Artificial Sequence
  mRNA product Design1 comprising derived and/or modified sequence from DENV-4 Consensus__C-P2A-SSc-prME (CDS opt1)
gggagaaagcuuaccaugaaccagcgcaagaaggugguccggcccccguucaacaugcugaagcgcgagcggaaccgcgugagcaccccgcagggccucgugaagcgguucuccaccgggcuguucagcggcaaggggccccugcgcaugguccucgccuucaucacguuccugcgggugcuguccaucccgcccaccgccggcauccucaagcgcugggggcagcugaagaagaacaaggcgaucaagauccugaucggcuuccggaaggagaucggccgcaugcucaacauccugaacgggcggaagcgcaacuucgaccugcucaagcuggccggcgacguggagagcaaccccgggccgagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2508 - RNA, 2260 nt, Artificial Sequence
  mRNA product Design1 comprising derived and/or modified sequence from DENV-4 Consensus__SSopt-prME(F108S)  (CDS opt1)
gggagaaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguccgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2509 - RNA, 2260 nt, Artificial Sequence
  mRNA product Design1 comprising derived and/or modified sequence from DENV-4 Consensus__SSopt-prME(V96H) (CDS opt1)
gggagaaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgaccacgucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2510 - RNA, 2260 nt, Artificial Sequence
  mRNA product Design1 comprising derived and/or modified sequence from DENV-4 Consensus__SSopt-prME(E186F) (CDS opt1)
gggagaaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcuucccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2511 - RNA, 2260 nt, Artificial Sequence
  mRNA product Design1 comprising derived and/or modified sequence from DENV-4 Consensus__SSopt-prME(R188L) (CDS opt1)
gggagaaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccugagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2512 - RNA, 2260 nt, Artificial Sequence
  mRNA product Design1 comprising derived and/or modified sequence from DENV-4 Consensus__SSopt-pr(D104A)MEdelstem_TM,(F108S)-JEV (CDS opt1)
gggagaaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggccaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccugagcgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2513 - RNA, 2260 nt, Artificial Sequence
  mRNA product Design1 comprising derived and/or modified sequence from DENV-4 Consensus__SSopt-prMEdelstem_TM,(H261N)-JEV (CDS opt1)
gggagaaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugaacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2514 - RNA, 2260 nt, Artificial Sequence
  mRNA product Design1 comprising derived and/or modified sequence from DENV-4 Consensus__SSopt-prMEdelstem_TM,(R188L,A267T)-JEV (CDS opt1)
gggagaaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccugagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcaccaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2515 - RNA, 2242 nt, Artificial Sequence
  mRNA product Design1 comprising derived and/or modified sequence from DENV-3 Consensus__SSc-prME (CDS opt1)
gggagaaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2516 - RNA, 2242 nt, Artificial Sequence
  mRNA product Design1 comprising derived and/or modified sequence from DENV-3 Consensus__SSc-prME(F108S) (CDS opt1)
gggagaaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuccgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2517 - RNA, 2242 nt, Artificial Sequence
  mRNA product Design1 comprising derived and/or modified sequence from DENV-3 Consensus__SSc-prME(R186L) (CDS opt1)
gggagaaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2518 - RNA, 2242 nt, Artificial Sequence
  mRNA product Design1 comprising derived and/or modified sequence from DENV-3 Consensus__SSc-prME(A265T) (CDS opt1)
gggagaaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2519 - RNA, 2242 nt, Artificial Sequence
  mRNA product Design1 comprising derived and/or modified sequence from DENV-3 Consensus__SSc-prMEdelstem_TM-JEV (CDS opt1)
gggagaaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2520 - RNA, 1543 nt, Artificial Sequence
  mRNA product Design1 comprising derived and/or modified sequence from DENV-3 Consensus__SSm-EdelTM (CDS opt1)
gggagaaagcuuaccaugacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2521 - RNA, 2590 nt, Artificial Sequence
  mRNA product Design1 comprising derived and/or modified sequence from DENV-3 Consensus__C-P2A-SSc-prME (CDS opt1)
gggagaaagcuuaccaugaacaaccagcgcaagaagaccggcaagccgagcaucaacaugcugaagcgggugcgcaaccgggucuccaccgggagccagcucgccaagcgcuucuccaagggccugcugaacgggcagggccccaugaagcucgugauggccuucaucgcguuccugcgguuccuggccaucccgcccacggccggggugcucgcccgcuggggcaccuucaagaagagcggcgccaucaagguccugaagggguucaagaaggagaucuccaacaugcugagcaucaucaacaagcggaagaagaacuucgaccugcucaagcuggccggcgacguggagagcaaccccgggccgaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2522 - RNA, 2254 nt, Artificial Sequence
  mRNA product Design1 comprising derived and/or modified sequence from DENV-3 Consensus__SSopt-prME (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2523 - RNA, 2254 nt, Artificial Sequence
  mRNA product Design1 comprising derived and/or modified sequence from DENV-3 Consensus__SSopt-prME(F108S)  (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucagcgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2524 - RNA, 2254 nt, Artificial Sequence
  mRNA product Design1 comprising derived and/or modified sequence from DENV-3 Consensus__SSopt-prME(H27N)  (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagaacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2525 - RNA, 2254 nt, Artificial Sequence
  mRNA product Design1 comprising derived and/or modified sequence from DENV-3 Consensus__SSopt-prME(T76I)  (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccauccagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2526 - RNA, 2254 nt, Artificial Sequence
  mRNA product Design1 comprising derived and/or modified sequence from DENV-3 Consensus__SSopt-prME(N89D)  (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccaggacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2527 - RNA, 2254 nt, Artificial Sequence
  mRNA product Design1 comprising derived and/or modified sequence from DENV-3 Consensus__SSopt-prME(Y96H) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacacccacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2528 - RNA, 2254 nt, Artificial Sequence
  mRNA product Design1 comprising derived and/or modified sequence from DENV-3 Consensus__SSopt-prME(K110E) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucggggagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2529 - RNA, 2254 nt, Artificial Sequence
  mRNA product Design1 comprising derived and/or modified sequence from DENV-3 Consensus__SSopt-prME(H149N) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagaaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2530 - RNA, 2254 nt, Artificial Sequence
  mRNA product Design1 comprising derived and/or modified sequence from DENV-3 Consensus__SSopt-prME(S184F) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuucccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2531 - RNA, 2254 nt, Artificial Sequence
  mRNA product Design1 comprising derived and/or modified sequence from DENV-3 Consensus__SSopt-prME(R186L) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2532 - RNA, 2254 nt, Artificial Sequence
  mRNA product Design1 comprising derived and/or modified sequence from DENV-3 Consensus__SSopt-prME(N240S) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagagcgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2533 - RNA, 2254 nt, Artificial Sequence
  mRNA product Design1 comprising derived and/or modified sequence from DENV-3 Consensus__SSopt-prME(M258L) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgcugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2534 - RNA, 2254 nt, Artificial Sequence
  mRNA product Design1 comprising derived and/or modified sequence from DENV-3 Consensus__SSopt-prME(H259N) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugaacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2535 - RNA, 2254 nt, Artificial Sequence
  mRNA product Design1 comprising derived and/or modified sequence from DENV-3 Consensus__SSopt-prME(H259R) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcgcacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2536 - RNA, 2254 nt, Artificial Sequence
  mRNA product Design1 comprising derived and/or modified sequence from DENV-3 Consensus__SSopt-prME(A265T) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2537 - RNA, 2254 nt, Artificial Sequence
  mRNA product Design1 comprising derived and/or modified sequence from DENV-3 Consensus__SSopt-prME(S296G) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugggcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2538 - RNA, 2254 nt, Artificial Sequence
  mRNA product Design1 comprising derived and/or modified sequence from DENV-3 Consensus__SSopt-prME(S311R) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggagguccgcgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2539 - RNA, 2254 nt, Artificial Sequence
  mRNA product Design1 comprising derived and/or modified sequence from DENV-3 Consensus__SSopt-prME(K321T) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaccguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2540 - RNA, 2254 nt, Artificial Sequence
  mRNA product Design1 comprising derived and/or modified sequence from DENV-3 Consensus__SSopt-prME(G28C,H242C) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacugcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgccugcgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2541 - RNA, 2254 nt, Artificial Sequence
  mRNA product Design1 comprising derived and/or modified sequence from DENV-3 Consensus__SSopt-prME(R186L,A265T) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2542 - RNA, 2254 nt, Artificial Sequence
  mRNA product Design1 comprising derived and/or modified sequence from DENV-3 Consensus__SSopt-pr(D104A)ME(F108S) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgcgaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucagcgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2543 - RNA, 2254 nt, Artificial Sequence
  mRNA product Design1 comprising derived and/or modified sequence from DENV-3 Consensus__SSopt-pr(D104A)ME(R186L,A265T) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgcgaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2544 - RNA, 2254 nt, Artificial Sequence
  mRNA product Design1 comprising derived and/or modified sequence from DENV-3 Consensus__SSopt-pr(D104A)ME(F108S,R186L,A265T) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgcgaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucagcgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2545 - RNA, 2233 nt, Artificial Sequence
  mRNA product Design1 comprising derived and/or modified sequence from DENV-3 Consensus__SSopt-prMEdel101-107,(R99P,F108N) (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccccgggaacgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2546 - RNA, 2254 nt, Artificial Sequence
  mRNA product Design1 comprising derived and/or modified sequence from DENV-3 Consensus__SSopt-prMEdelstem_TM-JEV (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2547 - RNA, 2254 nt, Artificial Sequence
  mRNA product Design1 comprising derived and/or modified sequence from DENV-3 Consensus__SSopt-pr(D104A)MEdelstem_TM,(F108S)-JEV (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgcgaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucagcgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2548 - RNA, 2254 nt, Artificial Sequence
  mRNA product Design1 comprising derived and/or modified sequence from DENV-3 Consensus__SSopt-pr(D104A)MEdelstem_TM,(R186L,A265T)-JEV (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgcgaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2549 - RNA, 2254 nt, Artificial Sequence
  mRNA product Design1 comprising derived and/or modified sequence from DENV-3 Consensus__SSopt-pr(D104A)MEdelstem_TM,(F108S,R186L,A265T)-JEV (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgcgaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucagcgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2550 - RNA, 2254 nt, Artificial Sequence
  mRNA product Design1 comprising derived and/or modified sequence from DENV-3 Consensus__SSopt-prMEdelstem_TM,(H259N)-JEV (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugaacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2551 - RNA, 2254 nt, Artificial Sequence
  mRNA product Design1 comprising derived and/or modified sequence from DENV-3 Consensus__SSopt-prMEdelstem_TM,(R186L,A265T)-JEV (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2552 - RNA, 2233 nt, Artificial Sequence
  mRNA product Design1 comprising derived and/or modified sequence from DENV-3 Consensus__SSopt-prMEdelstem_TM,del101-107,(R99P,F108N)-JEV (CDS opt1)
gggagaaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccccgggaacgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2553 - RNA, 3298 nt, Artificial Sequence
  mRNA product Design1 comprising derived and/or modified sequence from DENV-3 Consensus__SSc-prME-NS1 (CDS opt1)
gggagaaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacaugggcugcgugaucaacuggaaggggaaggagcugaagugcggcagcgggaucuucgucaccaacgaggugcacaccuggacggagcaguacaaguuccaggccgacucccccaagcgccucgccaccgcgaucgccggcgccugggagaacggggugugcggcauccggagcaccacccgcauggagaaccugcuguggaagcagaucgccaacgagcucaacuacauccugugggagaacaacaucaagcugacggucguggugggcgacaucaucgggguccucgagcagggcaagcggacccugaccccgcagcccauggagcugaaguacuccuggaagaccugggggaaggccaagaucgugacggcggagacccagaacagcuccuucaucaucgacggccccaacacccccgagugcccgagcgugucccgcgccuggaacgucugggagguggaggacuacggguucggcguguucaccacgaacaucuggcucaagcugcgggaggucuacacccagcugugcgaccaccgccucaugagcgccgccgugaaggacgagcgggcggugcacgccgacaugggcuacuggaucgagucccagaagaacgggagcuggaagcuggagaaggccucccugaucgaggucaagaccugcaccuggcccaagagccacacgcucugguccaacggcgugcuggagagcgacaugaucauccccaagucccuggccgggcccaucagccagcacaaccaccgcccgggcuaccacacccagaccgccggccccuggcaccucgggaagcuggagcuggacuucaacuacugcgagggcaccacgguggucaucaccgagaacugcgggacccggggccccucccuccgcaccacgaccgugagcgggaagcugauccacgaguggugcugccgguccugcacccugcccccgcuccgcuacaugggcgaggacggcugcugguacgggauggagauccggcccaucagcgagaaggaggagaacauggugaagagccuggucuccgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2554 - RNA, 2041 nt, Artificial Sequence
  mRNA product Design1 comprising derived and/or modified sequence from DENV-3 Consensus__SSm-EdelTM-linker-ferritin (CDS opt1)
gggagaaagcuuaccaugacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccagcggcggggacaucaucaagcuccugaacgagcaggugaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacguccccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2555 - RNA, 2038 nt, Artificial Sequence
  mRNA product Design1 comprising derived and/or modified sequence from DENV-3 Consensus__SStPA-WHbcAg-linker-EdelTM  (CDS opt1)
gggagaaagcuuaccauggacgccaugaagcgcggccugugcugcgugcuccugcugugcggggccgucuucguggacagcgugaccggcauggacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggcaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2556 - RNA, 5722 nt, Artificial Sequence
  mRNA product Design1 comprising derived and/or modified sequence from DENV-3 Consensus__SSc-prME-NS1-[IRES]-NS3 (CDS opt1)
gggagaaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacaugggcugcgugaucaacuggaaggggaaggagcugaagugcggcagcgggaucuucgucaccaacgaggugcacaccuggacggagcaguacaaguuccaggccgacucccccaagcgccucgccaccgcgaucgccggcgccugggagaacggggugugcggcauccggagcaccacccgcauggagaaccugcuguggaagcagaucgccaacgagcucaacuacauccugugggagaacaacaucaagcugacggucguggugggcgacaucaucgggguccucgagcagggcaagcggacccugaccccgcagcccauggagcugaaguacuccuggaagaccugggggaaggccaagaucgugacggcggagacccagaacagcuccuucaucaucgacggccccaacacccccgagugcccgagcgugucccgcgccuggaacgucugggagguggaggacuacggguucggcguguucaccacgaacaucuggcucaagcugcgggaggucuacacccagcugugcgaccaccgccucaugagcgccgccgugaaggacgagcgggcggugcacgccgacaugggcuacuggaucgagucccagaagaacgggagcuggaagcuggagaaggccucccugaucgaggucaagaccugcaccuggcccaagagccacacgcucugguccaacggcgugcuggagagcgacaugaucauccccaagucccuggccgggcccaucagccagcacaaccaccgcccgggcuaccacacccagaccgccggccccuggcaccucgggaagcuggagcuggacuucaacuacugcgagggcaccacgguggucaucaccgagaacugcgggacccggggccccucccuccgcaccacgaccgugagcgggaagcugauccacgaguggugcugccgguccugcacccugcccccgcuccgcuacaugggcgaggacggcugcugguacgggauggagauccggcccaucagcgagaaggaggagaacauggugaagagccuggucuccgcgugaccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauaugagcggcgugcugugggacguccccuccccgcccgagacccagaaggccgagcucgaggaggggguguaccgcaucaagcagcagggcaucuucgggaagacccaggugggcgucggggugcagaaggagggcguguuccacacgauguggcacgucacccggggcgccgugcugaccuacaacgggaagcgccuggagcccaacugggcgagcgugaagaaggaccucaucuccuacggcgggggcuggcggcugagcgcccaguggcagaagggggaggagguccaggugaucgccguggagcccggcaagaacccgaagaacuuccagaccaugcccggcacguuccagaccaccaccggggagaucggcgccaucgcccuggacuucaagcccgggacguccggcagccccaucaucaaccgcgagggcaaggucguggggcucuacggcaacgggguggucaccaagaacggcggguacguguccggcaucgcgcagaccaacgccgagccggacggccccacccccgagcuggaggaggagauguucaagaagcggaaccugacgaucauggaccuccaccccgggagcggcaagacccgcaaguaccugccggccaucgugcgggaggccaucaagcgccggcugcgcacccucauccuggcgcccacccgggucguggccgccgagauggaggaggcccugaaggggcuccccauccgcuaccagacgaccgccaccaaguccgagcacaccggccgggagaucguggaccugaugugccacgcgacguucaccaugcgccugcucagccccguccgggugccgaacuacaaccugaucaucauggacgaggcccacuucaccgaccccgccuccaucgccgcccgcggguacaucagcacccgggugggcaugggcgaggcggccgccaucuucaugacggccaccccgcccgggaccgccgacgcguucccgcaguccaacgcccccauccaggacgaggagcgcgacauccccgagcggagcuggaacuccggcaacgaguggaucaccgacuucgccgggaagacggucugguucgugcccagcaucaaggccggcaacgacaucgccaacugccugcgcaagaacgggaagaaggucauccagcucucccggaagaccuucgacaccgaguaccagaagaccaagcugaacgacugggacuucguggugacgaccgacaucagcgagaugggcgcgaacuucaaggccgaccgcgucaucgacccgcgccggugccugaagcccgugauccucaccgacggccccgagcgcgugauccuggccgggcccaugccggucaccgccgcguccgccgcccagcggcgcggccggguggggcgcaacccccagaaggagaacgaccaguacaucuucacgggccagccccugaacaacgacgaggaccacgcccacuggaccgaggccaagaugcuccuggacaacaucaacaccccggagggcaucauccccgcgcuguucgagcccgagcgggagaagagcgccgccaucgacggggaguaccgccucaagggcgagagccggaagaccuucguggagcugaugcgccggggcgaccugcccgucuggcucgcccacaagguggccuccgaggggaucaaguacaccgaccgcaaguggugcuucgacgggcagcggaacaaccagauccuggaggagaacauggacguggagaucuggacgaaggagggcgagaagaagaagcugcgcccgcgguggcucgacgcgcgcaccuacagcgacccccuggcccugaaggaguucaaggaguucgccgccggccggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2557 - RNA, 5722 nt, Artificial Sequence
  mRNA product Design1 comprising derived and/or modified sequence from DENV-3 Consensus__NS3-[IRES]- SSc-prME-NS1 (CDS opt1)
gggagaaagcuuaccaugagcggcgugcugugggacguccccuccccgcccgagacccagaaggccgagcucgaggaggggguguaccgcaucaagcagcagggcaucuucgggaagacccaggugggcgucggggugcagaaggagggcguguuccacacgauguggcacgucacccggggcgccgugcugaccuacaacgggaagcgccuggagcccaacugggcgagcgugaagaaggaccucaucuccuacggcgggggcuggcggcugagcgcccaguggcagaagggggaggagguccaggugaucgccguggagcccggcaagaacccgaagaacuuccagaccaugcccggcacguuccagaccaccaccggggagaucggcgccaucgcccuggacuucaagcccgggacguccggcagccccaucaucaaccgcgagggcaaggucguggggcucuacggcaacgggguggucaccaagaacggcggguacguguccggcaucgcgcagaccaacgccgagccggacggccccacccccgagcuggaggaggagauguucaagaagcggaaccugacgaucauggaccuccaccccgggagcggcaagacccgcaaguaccugccggccaucgugcgggaggccaucaagcgccggcugcgcacccucauccuggcgcccacccgggucguggccgccgagauggaggaggcccugaaggggcuccccauccgcuaccagacgaccgccaccaaguccgagcacaccggccgggagaucguggaccugaugugccacgcgacguucaccaugcgccugcucagccccguccgggugccgaacuacaaccugaucaucauggacgaggcccacuucaccgaccccgccuccaucgccgcccgcggguacaucagcacccgggugggcaugggcgaggcggccgccaucuucaugacggccaccccgcccgggaccgccgacgcguucccgcaguccaacgcccccauccaggacgaggagcgcgacauccccgagcggagcuggaacuccggcaacgaguggaucaccgacuucgccgggaagacggucugguucgugcccagcaucaaggccggcaacgacaucgccaacugccugcgcaagaacgggaagaaggucauccagcucucccggaagaccuucgacaccgaguaccagaagaccaagcugaacgacugggacuucguggugacgaccgacaucagcgagaugggcgcgaacuucaaggccgaccgcgucaucgacccgcgccggugccugaagcccgugauccucaccgacggccccgagcgcgugauccuggccgggcccaugccggucaccgccgcguccgccgcccagcggcgcggccggguggggcgcaacccccagaaggagaacgaccaguacaucuucacgggccagccccugaacaacgacgaggaccacgcccacuggaccgaggccaagaugcuccuggacaacaucaacaccccggagggcaucauccccgcgcuguucgagcccgagcgggagaagagcgccgccaucgacggggaguaccgccucaagggcgagagccggaagaccuucguggagcugaugcgccggggcgaccugcccgucuggcucgcccacaagguggccuccgaggggaucaaguacaccgaccgcaaguggugcuucgacgggcagcggaacaaccagauccuggaggagaacauggacguggagaucuggacgaaggagggcgagaagaagaagcugcgcccgcgguggcucgacgcgcgcaccuacagcgacccccuggcccugaaggaguucaaggaguucgccgccggccggaagugaccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacaugggcugcgugaucaacuggaaggggaaggagcugaagugcggcagcgggaucuucgucaccaacgaggugcacaccuggacggagcaguacaaguuccaggccgacucccccaagcgccucgccaccgcgaucgccggcgccugggagaacggggugugcggcauccggagcaccacccgcauggagaaccugcuguggaagcagaucgccaacgagcucaacuacauccugugggagaacaacaucaagcugacggucguggugggcgacaucaucgggguccucgagcagggcaagcggacccugaccccgcagcccauggagcugaaguacuccuggaagaccugggggaaggccaagaucgugacggcggagacccagaacagcuccuucaucaucgacggccccaacacccccgagugcccgagcgugucccgcgccuggaacgucugggagguggaggacuacggguucggcguguucaccacgaacaucuggcucaagcugcgggaggucuacacccagcugugcgaccaccgccucaugagcgccgccgugaaggacgagcgggcggugcacgccgacaugggcuacuggaucgagucccagaagaacgggagcuggaagcuggagaaggccucccugaucgaggucaagaccugcaccuggcccaagagccacacgcucugguccaacggcgugcuggagagcgacaugaucauccccaagucccuggccgggcccaucagccagcacaaccaccgcccgggcuaccacacccagaccgccggccccuggcaccucgggaagcuggagcuggacuucaacuacugcgagggcaccacgguggucaucaccgagaacugcgggacccggggccccucccuccgcaccacgaccgugagcgggaagcugauccacgaguggugcugccgguccugcacccugcccccgcuccgcuacaugggcgaggacggcugcugguacgggauggagauccggcccaucagcgagaaggaggagaacauggugaagagccuggucuccgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2558 - RNA, 4465 nt, Artificial Sequence
  mRNA product Design1 comprising derived and/or modified sequence from DENV-3 Consensus__SSm-EdelTM-linker-ferritin-[IRES]-NS3 (CDS opt1)
gggagaaagcuuaccaugacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccagcggcggggacaucaucaagcuccugaacgagcaggugaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacguccccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauaugagcggcgugcugugggacguccccuccccgcccgagacccagaaggccgagcucgaggaggggguguaccgcaucaagcagcagggcaucuucgggaagacccaggugggcgucggggugcagaaggagggcguguuccacacgauguggcacgucacccggggcgccgugcugaccuacaacgggaagcgccuggagcccaacugggcgagcgugaagaaggaccucaucuccuacggcgggggcuggcggcugagcgcccaguggcagaagggggaggagguccaggugaucgccguggagcccggcaagaacccgaagaacuuccagaccaugcccggcacguuccagaccaccaccggggagaucggcgccaucgcccuggacuucaagcccgggacguccggcagccccaucaucaaccgcgagggcaaggucguggggcucuacggcaacgggguggucaccaagaacggcggguacguguccggcaucgcgcagaccaacgccgagccggacggccccacccccgagcuggaggaggagauguucaagaagcggaaccugacgaucauggaccuccaccccgggagcggcaagacccgcaaguaccugccggccaucgugcgggaggccaucaagcgccggcugcgcacccucauccuggcgcccacccgggucguggccgccgagauggaggaggcccugaaggggcuccccauccgcuaccagacgaccgccaccaaguccgagcacaccggccgggagaucguggaccugaugugccacgcgacguucaccaugcgccugcucagccccguccgggugccgaacuacaaccugaucaucauggacgaggcccacuucaccgaccccgccuccaucgccgcccgcggguacaucagcacccgggugggcaugggcgaggcggccgccaucuucaugacggccaccccgcccgggaccgccgacgcguucccgcaguccaacgcccccauccaggacgaggagcgcgacauccccgagcggagcuggaacuccggcaacgaguggaucaccgacuucgccgggaagacggucugguucgugcccagcaucaaggccggcaacgacaucgccaacugccugcgcaagaacgggaagaaggucauccagcucucccggaagaccuucgacaccgaguaccagaagaccaagcugaacgacugggacuucguggugacgaccgacaucagcgagaugggcgcgaacuucaaggccgaccgcgucaucgacccgcgccggugccugaagcccgugauccucaccgacggccccgagcgcgugauccuggccgggcccaugccggucaccgccgcguccgccgcccagcggcgcggccggguggggcgcaacccccagaaggagaacgaccaguacaucuucacgggccagccccugaacaacgacgaggaccacgcccacuggaccgaggccaagaugcuccuggacaacaucaacaccccggagggcaucauccccgcgcuguucgagcccgagcgggagaagagcgccgccaucgacggggaguaccgccucaagggcgagagccggaagaccuucguggagcugaugcgccggggcgaccugcccgucuggcucgcccacaagguggccuccgaggggaucaaguacaccgaccgcaaguggugcuucgacgggcagcggaacaaccagauccuggaggagaacauggacguggagaucuggacgaaggagggcgagaagaagaagcugcgcccgcgguggcucgacgcgcgcaccuacagcgacccccuggcccugaaggaguucaaggaguucgccgccggccggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2559 - RNA, 4462 nt, Artificial Sequence
  mRNA product Design1 comprising derived and/or modified sequence from DENV-3 Consensus__SStPA-WHbcAg-linker-EdelTM-[IRES]-NS3 (CDS opt1)
gggagaaagcuuaccauggacgccaugaagcgcggccugugcugcgugcuccugcugugcggggccgucuucguggacagcgugaccggcauggacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggcaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccugaccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauaugagcggcgugcugugggacguccccuccccgcccgagacccagaaggccgagcucgaggaggggguguaccgcaucaagcagcagggcaucuucgggaagacccaggugggcgucggggugcagaaggagggcguguuccacacgauguggcacgucacccggggcgccgugcugaccuacaacgggaagcgccuggagcccaacugggcgagcgugaagaaggaccucaucuccuacggcgggggcuggcggcugagcgcccaguggcagaagggggaggagguccaggugaucgccguggagcccggcaagaacccgaagaacuuccagaccaugcccggcacguuccagaccaccaccggggagaucggcgccaucgcccuggacuucaagcccgggacguccggcagccccaucaucaaccgcgagggcaaggucguggggcucuacggcaacgggguggucaccaagaacggcggguacguguccggcaucgcgcagaccaacgccgagccggacggccccacccccgagcuggaggaggagauguucaagaagcggaaccugacgaucauggaccuccaccccgggagcggcaagacccgcaaguaccugccggccaucgugcgggaggccaucaagcgccggcugcgcacccucauccuggcgcccacccgggucguggccgccgagauggaggaggcccugaaggggcuccccauccgcuaccagacgaccgccaccaaguccgagcacaccggccgggagaucguggaccugaugugccacgcgacguucaccaugcgccugcucagccccguccgggugccgaacuacaaccugaucaucauggacgaggcccacuucaccgaccccgccuccaucgccgcccgcggguacaucagcacccgggugggcaugggcgaggcggccgccaucuucaugacggccaccccgcccgggaccgccgacgcguucccgcaguccaacgcccccauccaggacgaggagcgcgacauccccgagcggagcuggaacuccggcaacgaguggaucaccgacuucgccgggaagacggucugguucgugcccagcaucaaggccggcaacgacaucgccaacugccugcgcaagaacgggaagaaggucauccagcucucccggaagaccuucgacaccgaguaccagaagaccaagcugaacgacugggacuucguggugacgaccgacaucagcgagaugggcgcgaacuucaaggccgaccgcgucaucgacccgcgccggugccugaagcccgugauccucaccgacggccccgagcgcgugauccuggccgggcccaugccggucaccgccgcguccgccgcccagcggcgcggccggguggggcgcaacccccagaaggagaacgaccaguacaucuucacgggccagccccugaacaacgacgaggaccacgcccacuggaccgaggccaagaugcuccuggacaacaucaacaccccggagggcaucauccccgcgcuguucgagcccgagcgggagaagagcgccgccaucgacggggaguaccgccucaagggcgagagccggaagaccuucguggagcugaugcgccggggcgaccugcccgucuggcucgcccacaagguggccuccgaggggaucaaguacaccgaccgcaaguggugcuucgacgggcagcggaacaaccagauccuggaggagaacauggacguggagaucuggacgaaggagggcgagaagaagaagcugcgcccgcgguggcucgacgcgcgcaccuacagcgacccccuggcccugaaggaguucaaggaguucgccgccggccggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2560 - RNA, 2413 nt, Artificial Sequence
  mRNA product Design2 comprising derived and/or modified sequence from DENV-1 CYD23__SSc-prME (CDS opt1) R3539/R3540
ggggcgcugccuacggagguggcagccaucuccuucucggcaucaagcuuaccaugagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2561 - RNA, 2413 nt, Artificial Sequence
  mRNA product Design2 comprising derived and/or modified sequence from DENV-1 CYD23__SSc-prME(F108S) (CDS opt1)
ggggcgcugccuacggagguggcagccaucuccuucucggcaucaagcuuaccaugagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguccggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2562 - RNA, 2413 nt, Artificial Sequence
  mRNA product Design2 comprising derived and/or modified sequence from DENV-1 CYD23__SSc-prMEdelstem_TM-JEV (CDS opt1) R3541/R3542
ggggcgcugccuacggagguggcagccaucuccuucucggcaucaagcuuaccaugagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2563 - RNA, 2761 nt, Artificial Sequence
  mRNA product Design2 comprising derived and/or modified sequence from DENV-1 CYD23__C-P2A-SSc-prME (CDS opt1) R3781/R3782
ggggcgcugccuacggagguggcagccaucuccuucucggcaucaagcuuaccaugaacaaccagcgcaagaagaccgcccggccgagcuucaacaugcugaagcgcgcccggaaccgcguguccaccgucagccagcucgcgaagcgguucuccaagggccugcugagcgggcagggccccaugaagcucgugauggccuucaucgccuuccugcgcuuccuggccaucccgcccacggccgggauccucgcgcgguggggcuccuucaagaagaacggggccaucaaggugcugcgcggcuucaagaaggagaucagcaacaugcugaacaucaugaaccggcgccggaagaacuucgaccugcucaagcuggccggcgacguggagagcaaccccgggccgagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccuccucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2564 - RNA, 2425 nt, Artificial Sequence
  mRNA product Design2 comprising derived and/or modified sequence from DENV-1 CYD23__SSopt-prME(F108S)  (CDS opt1)
ggggcgcugccuacggagguggcagccaucuccuucucggcaucaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguccggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2565 - RNA, 2425 nt, Artificial Sequence
  mRNA product Design2 comprising derived and/or modified sequence from DENV-1 CYD23__SSopt-prME(F96H) (CDS opt1)
ggggcgcugccuacggagguggcagccaucuccuucucggcaucaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcacccacguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2566 - RNA, 2425 nt, Artificial Sequence
  mRNA product Design2 comprising derived and/or modified sequence from DENV-1 CYD23__SSopt-prME(S186F) (CDS opt1)
ggggcgcugccuacggagguggcagccaucuccuucucggcaucaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcuucccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2567 - RNA, 2425 nt, Artificial Sequence
  mRNA product Design2 comprising derived and/or modified sequence from DENV-1 CYD23__SSopt-prME(R188L) (CDS opt1)
ggggcgcugccuacggagguggcagccaucuccuucucggcaucaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccugacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggguccagcaucggcaagauguucgaggccaccgcccgcggggcccggcgcauggcgauccugggcgacacggccugggacuucggguccaucggcggcguguucaccagcgucgggaagcuggugcaccagaucuucggcaccgccuacggggugcucuucuccggcgucagcuggaccaugaagaucgggaucggcgugcugcugacguggcucggccugaacucccgcagcaccucccugagcaugaccugcaucgccguggggcucgucacccuguaccugggcgugauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2568 - RNA, 2425 nt, Artificial Sequence
  mRNA product Design2 comprising derived and/or modified sequence from DENV-1 CYD23__SSopt-pr(D104A)MEdelstem_TM,(F108S)-JEV (CDS opt1)
ggggcgcugccuacggagguggcagccaucuccuucucggcaucaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgccaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcugagcggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2569 - RNA, 2425 nt, Artificial Sequence
  mRNA product Design2 comprising derived and/or modified sequence from DENV-1 CYD23__SSopt-prMEdelstem_TM,(H261N)-JEV (CDS opt1)
ggggcgcugccuacggagguggcagccaucuccuucucggcaucaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccgcacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugaacaccgcccugacgggggccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2570 - RNA, 2425 nt, Artificial Sequence
  mRNA product Design2 comprising derived and/or modified sequence from DENV-1 CYD23__SSopt-prMEdelstem_TM,(R188L,A267T)-JEV (CDS opt1)
ggggcgcugccuacggagguggcagccaucuccuucucggcaucaagcuuaccaugaagcgcaagaagagcgugaccaugcugcucaugcugaugcccaccgcccuggccuuccaccucacgacccgcggcggggagccgcacaugaucgucuccaagcaggagcggggcaagagccugcuguucaagaccuccgcgggggugaacaugugcacccucaucgccauggaccugggcgagcugugcgaggacacgaugaccuacaagugcccccgcaucaccgaggccgagcccgacgacguggacugcuggugcaacgccaccgacacgugggucaccuacgggaccugcagccagaccggcgagcaccggcgcgacaagcgguccguggcccucgcgccccacgugggccuggggcuggagacgcgcaccgagaccuggaugagcuccgagggcgccuggaagcagauccagcgggucgagaccugggcccuccgccacccgggguucacggugaucgcccuguuccuggcgcacgccaucggcaccagcaucacccagaaggggaucaucuucauccuccugaugcuggugacccccuccauggccaugcggugcgucggcaucggcagccgcgacuucguggaggggcucuccggcgccacguggguggacgucgugcuggagcacgggagcugcgugaccaccauggccaaggacaagcccacccuggacaucgagcuccugaagacggaggucaccaacccggcggugcugcggaagcucugcaucgaggccaagaucuccaacaccaccacggacagccgcugcccgacccagggcgaggccacccugguggaggagcaggacgccaacuucgucugccggcgcaccuucguggaccggggcugggggaacggcugcgggcuguucggcaaggggucccucaucacgugcgccaaguucaagugcgugaccaagcuggagggcaagaucguccaguacgagaaccugaaguacagcgugaucgugaccguccacaccggcgaccagcaccagguggggaacgaguccacggagcacggcaccaccgcgaccaucaccccgcaggcccccacgaccgagauccagcucaccgacuacggggcccugacccuggacugcagcccccugacgggccucgacuucaacgagaugguccugcugaccaugaaggagaaguccuggcucgugcacaagcagugguuccuggaccugccccuccccuggaccagcggggccagcaccucccaggagacguggaaccggcaggaccugcuggugaccuucaagaccgcccacgcgaagaagcaggaggucguggugcucggcagccaggagggcgccaugcacaccgcccugacggggaccaccgagauccagaccuccggcaccacgaccaucuucgccgggcaccugaagugccgccucaagauggacaagcugacccugaagggcaugagcuacgucaugugcaccggguccuucaagcuggagaaggagguggcggagacgcagcacggcaccgugcucguccagaucaaguacgagggcaccgacgcccccugcaagauccccuucagcacccaggacgagaagggggugacgcagaacggccggcugaucaccgccaaccccaucgugaccgacaaggagaagcccgucaacaucgaggccgagccgcccuucggggaguccuacaucgugaucggcgcgggcgagaaggcccugaagcucagcugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2571 - RNA, 2413 nt, Artificial Sequence
  mRNA product Design2 comprising derived and/or modified sequence from DENV-2 CYD2-T__SSc-prME (CDS opt1) R3545/R3546
ggggcgcugccuacggagguggcagccaucuccuucucggcaucaagcuuaccaugagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2572 - RNA, 2413 nt, Artificial Sequence
  mRNA product Design2 comprising derived and/or modified sequence from DENV-2 CYD2-T__SSc-prME(F108S) (CDS opt1)
ggggcgcugccuacggagguggcagccaucuccuucucggcaucaagcuuaccaugagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuccgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2573 - RNA, 2413 nt, Artificial Sequence
  mRNA product Design2 comprising derived and/or modified sequence from DENV-2 CYD2-T__SSc-prMEdelstem_TM-JEV (CDS opt1) R3547/R3548
ggggcgcugccuacggagguggcagccaucuccuucucggcaucaagcuuaccaugagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2574 - RNA, 1714 nt, Artificial Sequence
  mRNA product Design2 comprising derived and/or modified sequence from DENV-2 CYD2-T__SSm-EdelTM (CDS opt1) R3549/R3550
ggggcgcugccuacggagguggcagccaucuccuucucggcaucaagcuuaccauguuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2575 - RNA, 2761 nt, Artificial Sequence
  mRNA product Design2 comprising derived and/or modified sequence from DENV-2 CYD2-T__C-P2A-SSc-prME (CDS opt1) R3783/R3784
ggggcgcugccuacggagguggcagccaucuccuucucggcaucaagcuuaccaugaacaaccagcgcaagaaggccaagaacaccccguucaacaugcugaagcgggagcgcaaccgggugagcaccguccagcagcucacgaagcgcuucucccugggcaugcugcaggggcggggcccccucaagcuguucauggcccugguggcguuccuccgcuuccugaccaucccgcccaccgccgggauccugaagcgguggggcaccaucaagaagagcaaggccaucaacgugcuccgcggguuccggaaggagaucggccgcaugcugaacauccugaaccggcgccggcgcaacuucgaccugcucaagcuggccggcgacguggagagcaaccccgggccgagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2576 - RNA, 2425 nt, Artificial Sequence
  mRNA product Design2 comprising derived and/or modified sequence from DENV-2 CYD2-T__SSopt-prME(F108S)  (CDS opt1)
ggggcgcugccuacggagguggcagccaucuccuucucggcaucaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuccgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2577 - RNA, 2425 nt, Artificial Sequence
  mRNA product Design2 comprising derived and/or modified sequence from DENV-2 CYD2-T__SSopt-prME(M96H) (CDS opt1)
ggggcgcugccuacggagguggcagccaucuccuucucggcaucaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacucccacguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2578 - RNA, 2425 nt, Artificial Sequence
  mRNA product Design2 comprising derived and/or modified sequence from DENV-2 CYD2-T__SSopt-prME(S186F) (CDS opt1)
ggggcgcugccuacggagguggcagccaucuccuucucggcaucaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuucccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2579 - RNA, 2425 nt, Artificial Sequence
  mRNA product Design2 comprising derived and/or modified sequence from DENV-2 CYD2-T__SSopt-prME(R188L) (CDS opt1)
ggggcgcugccuacggagguggcagccaucuccuucucggcaucaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcugacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcuccaucgggcagauguucgagaccaccaugcggggcgccaagcgcauggcgauccugggcgacaccgccugggacuucgggagccugggcgggguguucacguccaucggcaaggcccugcaccagguguucggggccaucuacggcgccgcguucagcggcgucuccuggaccaugaagauccucaucggggugaucaucaccuggaucggcaugaacagccgguccaccagccuguccgugacgcugguccucguggggaucgugacccuguaccugggcgucauggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2580 - RNA, 2425 nt, Artificial Sequence
  mRNA product Design2 comprising derived and/or modified sequence from DENV-2 CYD2-T__SSopt-pr(D104A)MEdelstem_TM,(F108S)-JEV (CDS opt1)
ggggcgcugccuacggagguggcagccaucuccuucucggcaucaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgccaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucagcgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2581 - RNA, 2425 nt, Artificial Sequence
  mRNA product Design2 comprising derived and/or modified sequence from DENV-2 CYD2-T__SSopt-prMEdelstem_TM,(H261N)-JEV (CDS opt1)
ggggcgcugccuacggagguggcagccaucuccuucucggcaucaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcggacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugaacacggcgcugaccggcgccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2582 - RNA, 2425 nt, Artificial Sequence
  mRNA product Design2 comprising derived and/or modified sequence from DENV-2 CYD2-T__SSopt-prMEdelstem_TM,(R188L,A267T)-JEV (CDS opt1)
ggggcgcugccuacggagguggcagccaucuccuucucggcaucaagcuuaccaugaagcgcaagaagagcgccggcaugaucaucaugcugauccccaccgugauggccuuccaccucaccacgcgcaacggggagccgcacaugaucgucucccggcaggagaagggcaagagccugcuguucaagaccgaggacggggugaacaugugcacccucauggcgauggaccugggcgagcugugcgaggacaccaucacguacaagugcccccuccugcgccagaacgagcccgaggacaucgacugcuggugcaacuccaccagcaccugggugaccuacgggacgugcaccaccaugggcgagcaccggcgcgagaagcgguccgucgcccuggugccccacgugggcauggggcucgagacccgcacggagaccuggaugagcuccgagggcgccuggaagcacguccagcggaucgagaccuggauccugcgccacccgggguucaccaugauggccgccauccuggcguacacgaucggcaccacccacuuccagcgggcccucaucuucauccugcugaccgccgugacgcccagcaugaccaugcgcugcaucgggauguccaaccgggacuucguggagggcgucagcggcggguccuggguggacaucgugcucgagcacggcagcugcgucaccaccauggccaagaacaagcccacgcuggacuucgagcugaucaagaccgaggcgaagcagcccgccacccuccgcaaguacugcaucgaggccaagcugaccaacacgaccaccgagucccggugcccgacccagggggagcccagccugaacgaggagcaggacaagcgcuucgugugcaagcacuccaugguggaccggggcuggggcaacgggugcggccucuucgggaagggcgggaucgucacgugcgccauguuccgcugcaagaagaacauggagggcaagguggugcagcccgagaaccuggaguacaccaucgucaucaccccgcacagcggcgaggagcacgccguggggaacgacaccggcaagcacgggaaggagaucaagaucacgccccaguccagcaucaccgaggcggagcugaccggcuacgggaccgugaccauggagugcuccccgcugacgggccucgacuucaacgagaugguccugcugcagauggagaacaaggccuggcucgugcaccgccagugguuccuggaccugccccuccccuggcugccgggcgccgacacccaggggagcaacuggauccagaaggagacccuggugaccuucaagaacccccacgccaagaagcaggacgucgugguccucggcagccaggagggggccaugcacacggcgcugaccggcaccaccgagauccagauguccagcgggaaccugcucuucaccggccaccugaagugccggcugcgcauggacaagcuccagcugaagggcauguccuacagcaugugcacggggaaguucaagguggugaaggagaucgccgagacccagcacggcaccaucgucauccgggugcaguacgagggggacggcucccccugcaagauccccuucgagaucauggaccuggagaagcgccacgugcucggccgccugaucaccgucaaccccaucgugacggagaaggacagccccgugaacaucgaggccgagccgcccuucggggacuccuacaucaucaucggcgucgagccggggcagcugaagcucaacugguucaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2583 - RNA, 2413 nt, Artificial Sequence
  mRNA product Design2 comprising derived and/or modified sequence from DENV-4 Consensus__SSc-prME (CDS opt1) R3559/R3560
ggggcgcugccuacggagguggcagccaucuccuucucggcaucaagcuuaccaugagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2584 - RNA, 2413 nt, Artificial Sequence
  mRNA product Design2 comprising derived and/or modified sequence from DENV-4 Consensus__SSc-prME(F108S) (CDS opt1)
ggggcgcugccuacggagguggcagccaucuccuucucggcaucaagcuuaccaugagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguccgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2585 - RNA, 2413 nt, Artificial Sequence
  mRNA product Design2 comprising derived and/or modified sequence from DENV-4 Consensus__SSc-prMEdelstem_TM-JEV (CDS opt1) R3561/R3562
ggggcgcugccuacggagguggcagccaucuccuucucggcaucaagcuuaccaugagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2586 - RNA, 1714 nt, Artificial Sequence
  mRNA product Design2 comprising derived and/or modified sequence from DENV-4 Consensus__SSm-EdelTM (CDS opt1) R3563/R3564
ggggcgcugccuacggagguggcagccaucuccuucucggcaucaagcuuaccaugauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2587 - RNA, 2758 nt, Artificial Sequence
  mRNA product Design2 comprising derived and/or modified sequence from DENV-4 Consensus__C-P2A-SSc-prME (CDS opt1) R3787/R3788
ggggcgcugccuacggagguggcagccaucuccuucucggcaucaagcuuaccaugaaccagcgcaagaaggugguccggcccccguucaacaugcugaagcgcgagcggaaccgcgugagcaccccgcagggccucgugaagcgguucuccaccgggcuguucagcggcaaggggccccugcgcaugguccucgccuucaucacguuccugcgggugcuguccaucccgcccaccgccggcauccucaagcgcugggggcagcugaagaagaacaaggcgaucaagauccugaucggcuuccggaaggagaucggccgcaugcucaacauccugaacgggcggaagcgcaacuucgaccugcucaagcuggccggcgacguggagagcaaccccgggccgagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2588 - RNA, 2425 nt, Artificial Sequence
  mRNA product Design2 comprising derived and/or modified sequence from DENV-4 Consensus__SSopt-prME(F108S)  (CDS opt1)
ggggcgcugccuacggagguggcagccaucuccuucucggcaucaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguccgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2589 - RNA, 2425 nt, Artificial Sequence
  mRNA product Design2 comprising derived and/or modified sequence from DENV-4 Consensus__SSopt-prME(V96H) (CDS opt1)
ggggcgcugccuacggagguggcagccaucuccuucucggcaucaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgaccacgucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2590 - RNA, 2425 nt, Artificial Sequence
  mRNA product Design2 comprising derived and/or modified sequence from DENV-4 Consensus__SSopt-prME(E186F) (CDS opt1)
ggggcgcugccuacggagguggcagccaucuccuucucggcaucaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcuucccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2591 - RNA, 2425 nt, Artificial Sequence
  mRNA product Design2 comprising derived and/or modified sequence from DENV-4 Consensus__SSopt-prME(R188L) (CDS opt1)
ggggcgcugccuacggagguggcagccaucuccuucucggcaucaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccugagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaaggggagcuccaucggcaagauguucgagagcaccuaccgcggggccaagcggauggccauccugggcgagacggcgugggacuucggguccgugggcggccucuucaccagccuggggaaggccguccaccagguguucggcuccguguacaccaccauguucgggggcgucagcuggaugauccgcauccugaucggguuccuggugcucuggaucggcacgaacucccggaacaccagcauggccaugaccugcaucgccgugggcgggaucacccuguuccugggcuucacgguccaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2592 - RNA, 2425 nt, Artificial Sequence
  mRNA product Design2 comprising derived and/or modified sequence from DENV-4 Consensus__SSopt-pr(D104A)MEdelstem_TM,(F108S)-JEV (CDS opt1)
ggggcgcugccuacggagguggcagccaucuccuucucggcaucaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggccaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccugagcgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2593 - RNA, 2425 nt, Artificial Sequence
  mRNA product Design2 comprising derived and/or modified sequence from DENV-4 Consensus__SSopt-prMEdelstem_TM,(H261N)-JEV (CDS opt1)
ggggcgcugccuacggagguggcagccaucuccuucucggcaucaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccggagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugaacagcgcccuggccggcgcgaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2594 - RNA, 2425 nt, Artificial Sequence
  mRNA product Design2 comprising derived and/or modified sequence from DENV-4 Consensus__SSopt-prMEdelstem_TM,(R188L,A267T)-JEV (CDS opt1)
ggggcgcugccuacggagguggcagccaucuccuucucggcaucaagcuuaccaugaagcgcaagaagagcaccaucacccugcucugccugauccccacggugauggccuuccaccuguccacccgcgacggcgagccgcucaugaucgucgccaagcacgagcgggggcgcccccugcuguucaagaccaccgagggcaucaacaagugcacgcucaucgcgauggaccugggggagaugugcgaggacaccgugaccuacaagugcccccugcucgugaacaccgagcccgaggacaucgacugcuggugcaaccugacgagcaccugggucauguacggcaccugcacccaguccggggagcggcgccgggagaagcgcagcguggcccugacgccgcacuccggcaugggccucgagacccgggccgagaccuggaugagcuccgagggggccuggaagcacgcccagcgcguggagagcuggauccugcggaaccccggcuucgcgcugcucgccggguucauggccuacaugaucggccagaccgggauccagcgcacggucuucuucgugcugaugaugcugguggcccccuccuacggcaugcggugcgucggcguggggaaccgcgacuucguggagggcgucagcgggggcgcguggguggaccucgugcuggagcacggcgggugcgucaccaccauggcccagggcaagcccacccuggacuucgagcucacgaagaccaccgccaaggagguggcccugcugcggaccuacugcaucgaggccuccaucagcaacaucacgaccgcgacccgcugcccgacccagggggagcccuaccucaaggaggagcaggaccagcaguacaucugccggcgcgacguggucgaccggggcugggggaacggcugcggccuguucgggaagggcgggguggugacgugcgccaaguucuccugcagcggcaagaucaccgggaaccugguccagaucgagaaccucgaguacaccgugguggucaccgugcacaacggcgacacgcacgccgucggcaacgacaccuccaaccacggggugaccgccaccaucacgccccgcagccccuccguggaggucaagcugccggacuacggcgagcugacccucgacugcgagccccugagcgggaucgacuucaacgagaugauccugaugaagaugaagaagaagaccuggcuggugcacaagcagugguuccucgaccugccccugcccuggaccgccggcgcggacaccuccgaggugcacuggaacuacaaggagcgcauggucacguucaaggugccgcacgccaagcggcaggacgugaccguccucgggagccaggagggcgccaugcacagcgcccuggccggcaccaccgagguggacuccggggacggcaaccacauguucgccgggcaccugaagugcaaggugcgcauggagaagcuccgcaucaagggcaugagcuacaccaugugcuccggcaaguucagcaucgacaaggagauggccgagacgcagcacgggaccaccgucgugaaggugaaguacgagggcgccggggcccccugcaagguccccaucgagauccgggacgugaacaaggagaagguggucggccgcgugaucuccagcaccccgcuggcggagaacacgaacuccgugaccaacaucgagcuggagccgcccuucggggacagcuacaucgucaucggcgugggcaacuccgcccucacccugcacugguuccggaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2595 - RNA, 2407 nt, Artificial Sequence
  mRNA product Design2 comprising derived and/or modified sequence from DENV-3 Consensus__SSc-prME (CDS opt1) R3551/R3552
ggggcgcugccuacggagguggcagccaucuccuucucggcaucaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2596 - RNA, 2407 nt, Artificial Sequence
  mRNA product Design2 comprising derived and/or modified sequence from DENV-3 Consensus__SSc-prME(F108S) (CDS opt1) R3764/R3765
ggggcgcugccuacggagguggcagccaucuccuucucggcaucaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuccgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2597 - RNA, 2407 nt, Artificial Sequence
  mRNA product Design2 comprising derived and/or modified sequence from DENV-3 Consensus__SSc-prME(R186L) (CDS opt1) R3557/R3558
ggggcgcugccuacggagguggcagccaucuccuucucggcaucaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2598 - RNA, 2407 nt, Artificial Sequence
  mRNA product Design2 comprising derived and/or modified sequence from DENV-3 Consensus__SSc-prME(A265T) (CDS opt1) R3779/R3780
ggggcgcugccuacggagguggcagccaucuccuucucggcaucaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2599 - RNA, 2407 nt, Artificial Sequence
  mRNA product Design2 comprising derived and/or modified sequence from DENV-3 Consensus__SSc-prMEdelstem_TM-JEV (CDS opt1) R3553/R3554
ggggcgcugccuacggagguggcagccaucuccuucucggcaucaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2600 - RNA, 1708 nt, Artificial Sequence
  mRNA product Design2 comprising derived and/or modified sequence from DENV-3 Consensus__SSm-EdelTM (CDS opt1) R3555/R3556
ggggcgcugccuacggagguggcagccaucuccuucucggcaucaagcuuaccaugacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2601 - RNA, 2755 nt, Artificial Sequence
  mRNA product Design2 comprising derived and/or modified sequence from DENV-3 Consensus__C-P2A-SSc-prME (CDS opt1) R3785/R3786
ggggcgcugccuacggagguggcagccaucuccuucucggcaucaagcuuaccaugaacaaccagcgcaagaagaccggcaagccgagcaucaacaugcugaagcgggugcgcaaccgggucuccaccgggagccagcucgccaagcgcuucuccaagggccugcugaacgggcagggccccaugaagcucgugauggccuucaucgcguuccugcgguuccuggccaucccgcccacggccggggugcucgcccgcuggggcaccuucaagaagagcggcgccaucaagguccugaagggguucaagaaggagaucuccaacaugcugagcaucaucaacaagcggaagaagaacuucgaccugcucaagcuggccggcgacguggagagcaaccccgggccgaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2602 - RNA, 2419 nt, Artificial Sequence
  mRNA product Design2 comprising derived and/or modified sequence from DENV-3 Consensus__SSopt-prME (CDS opt1)
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2603 - RNA, 2419 nt, Artificial Sequence
  mRNA product Design2 comprising derived and/or modified sequence from DENV-3 Consensus__SSopt-prME(F108S)  (CDS opt1) R4457/R4458
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucagcgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2604 - RNA, 2419 nt, Artificial Sequence
  mRNA product Design2 comprising derived and/or modified sequence from DENV-3 Consensus__SSopt-prME(H27N)  (CDS opt1) R4471/R4472
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagaacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2605 - RNA, 2419 nt, Artificial Sequence
  mRNA product Design2 comprising derived and/or modified sequence from DENV-3 Consensus__SSopt-prME(T76I)  (CDS opt1) R4485/R4486
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccauccagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2606 - RNA, 2419 nt, Artificial Sequence
  mRNA product Design2 comprising derived and/or modified sequence from DENV-3 Consensus__SSopt-prME(N89D)  (CDS opt1) R4487/R4488
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccaggacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2607 - RNA, 2419 nt, Artificial Sequence
  mRNA product Design2 comprising derived and/or modified sequence from DENV-3 Consensus__SSopt-prME(Y96H) (CDS opt1) R4489/R4490
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacacccacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2608 - RNA, 2419 nt, Artificial Sequence
  mRNA product Design2 comprising derived and/or modified sequence from DENV-3 Consensus__SSopt-prME(K110E) (CDS opt1) R4491/R4492
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucggggagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2609 - RNA, 2419 nt, Artificial Sequence
  mRNA product Design2 comprising derived and/or modified sequence from DENV-3 Consensus__SSopt-prME(H149N) (CDS opt1) R4481/R4482
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagaaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2610 - RNA, 2419 nt, Artificial Sequence
  mRNA product Design2 comprising derived and/or modified sequence from DENV-3 Consensus__SSopt-prME(S184F) (CDS opt1) R4483/R4484
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuucccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2611 - RNA, 2419 nt, Artificial Sequence
  mRNA product Design2 comprising derived and/or modified sequence from DENV-3 Consensus__SSopt-prME(R186L) (CDS opt1) R4445/R4446
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2612 - RNA, 2419 nt, Artificial Sequence
  mRNA product Design2 comprising derived and/or modified sequence from DENV-3 Consensus__SSopt-prME(N240S) (CDS opt1) R4493/R4494
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagagcgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2613 - RNA, 2419 nt, Artificial Sequence
  mRNA product Design2 comprising derived and/or modified sequence from DENV-3 Consensus__SSopt-prME(M258L) (CDS opt1) R4495/R4496
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgcugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2614 - RNA, 2419 nt, Artificial Sequence
  mRNA product Design2 comprising derived and/or modified sequence from DENV-3 Consensus__SSopt-prME(H259N) (CDS opt1) R4473/R4474
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugaacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2615 - RNA, 2419 nt, Artificial Sequence
  mRNA product Design2 comprising derived and/or modified sequence from DENV-3 Consensus__SSopt-prME(H259R) (CDS opt1) R4477/R4478
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcgcacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2616 - RNA, 2419 nt, Artificial Sequence
  mRNA product Design2 comprising derived and/or modified sequence from DENV-3 Consensus__SSopt-prME(A265T) (CDS opt1) R4447/R4448
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2617 - RNA, 2419 nt, Artificial Sequence
  mRNA product Design2 comprising derived and/or modified sequence from DENV-3 Consensus__SSopt-prME(S296G) (CDS opt1) R4497/R4498
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugggcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2618 - RNA, 2419 nt, Artificial Sequence
  mRNA product Design2 comprising derived and/or modified sequence from DENV-3 Consensus__SSopt-prME(S311R) (CDS opt1) R4499/R4500
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggagguccgcgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2619 - RNA, 2419 nt, Artificial Sequence
  mRNA product Design2 comprising derived and/or modified sequence from DENV-3 Consensus__SSopt-prME(K321T) (CDS opt1) R4501/R4502
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaccguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2620 - RNA, 2419 nt, Artificial Sequence
  mRNA product Design2 comprising derived and/or modified sequence from DENV-3 Consensus__SSopt-prME(G28C,H242C) (CDS opt1) R4479/R4480
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacugcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgccugcgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2621 - RNA, 2419 nt, Artificial Sequence
  mRNA product Design2 comprising derived and/or modified sequence from DENV-3 Consensus__SSopt-prME(R186L,A265T) (CDS opt1) R4449/R4450
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2622 - RNA, 2419 nt, Artificial Sequence
  mRNA product Design2 comprising derived and/or modified sequence from DENV-3 Consensus__SSopt-pr(D104A)ME(F108S) (CDS opt1) R4459/R4460
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgcgaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucagcgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2623 - RNA, 2419 nt, Artificial Sequence
  mRNA product Design2 comprising derived and/or modified sequence from DENV-3 Consensus__SSopt-pr(D104A)ME(R186L,A265T) (CDS opt1) R4453/R4454
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgcgaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2624 - RNA, 2419 nt, Artificial Sequence
  mRNA product Design2 comprising derived and/or modified sequence from DENV-3 Consensus__SSopt-pr(D104A)ME(F108S,R186L,A265T) (CDS opt1) R4463/R4464
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgcgaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucagcgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2625 - RNA, 2398 nt, Artificial Sequence
  mRNA product Design2 comprising derived and/or modified sequence from DENV-3 Consensus__SSopt-prMEdel101-107,(R99P,F108N) (CDS opt1) R4467/R4468
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccccgggaacgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2626 - RNA, 2419 nt, Artificial Sequence
  mRNA product Design2 comprising derived and/or modified sequence from DENV-3 Consensus__SSopt-prMEdelstem_TM-JEV (CDS opt1)
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2627 - RNA, 2419 nt, Artificial Sequence
  mRNA product Design2 comprising derived and/or modified sequence from DENV-3 Consensus__SSopt-pr(D104A)MEdelstem_TM,(F108S)-JEV (CDS opt1) R4461/R4462
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgcgaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucagcgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2628 - RNA, 2419 nt, Artificial Sequence
  mRNA product Design2 comprising derived and/or modified sequence from DENV-3 Consensus__SSopt-pr(D104A)MEdelstem_TM,(R186L,A265T)-JEV (CDS opt1) R4455/R4456
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgcgaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2629 - RNA, 2419 nt, Artificial Sequence
  mRNA product Design2 comprising derived and/or modified sequence from DENV-3 Consensus__SSopt-pr(D104A)MEdelstem_TM,(F108S,R186L,A265T)-JEV (CDS opt1) R4465/R4466
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgcgaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucagcgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2630 - RNA, 2419 nt, Artificial Sequence
  mRNA product Design2 comprising derived and/or modified sequence from DENV-3 Consensus__SSopt-prMEdelstem_TM,(H259N)-JEV (CDS opt1) R4475/R4476
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugaacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2631 - RNA, 2419 nt, Artificial Sequence
  mRNA product Design2 comprising derived and/or modified sequence from DENV-3 Consensus__SSopt-prMEdelstem_TM,(R186L,A265T)-JEV (CDS opt1) R4451/R4452
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcugacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccgggaccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2632 - RNA, 2398 nt, Artificial Sequence
  mRNA product Design2 comprising derived and/or modified sequence from DENV-3 Consensus__SSopt-prMEdelstem_TM,del101-107,(R99P,F108N)-JEV (CDS opt1) R4469/R4470
ggggcgcugccuacggagguggcagccaucuccuucucggcaucaagcuuaccaugaagcgcaagaagaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccccgggaacgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2633 - RNA, 3463 nt, Artificial Sequence
  mRNA product Design2 comprising derived and/or modified sequence from DENV-3 Consensus__SSc-prME-NS1 (CDS opt1) R3789/R3790
ggggcgcugccuacggagguggcagccaucuccuucucggcaucaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacaugggcugcgugaucaacuggaaggggaaggagcugaagugcggcagcgggaucuucgucaccaacgaggugcacaccuggacggagcaguacaaguuccaggccgacucccccaagcgccucgccaccgcgaucgccggcgccugggagaacggggugugcggcauccggagcaccacccgcauggagaaccugcuguggaagcagaucgccaacgagcucaacuacauccugugggagaacaacaucaagcugacggucguggugggcgacaucaucgggguccucgagcagggcaagcggacccugaccccgcagcccauggagcugaaguacuccuggaagaccugggggaaggccaagaucgugacggcggagacccagaacagcuccuucaucaucgacggccccaacacccccgagugcccgagcgugucccgcgccuggaacgucugggagguggaggacuacggguucggcguguucaccacgaacaucuggcucaagcugcgggaggucuacacccagcugugcgaccaccgccucaugagcgccgccgugaaggacgagcgggcggugcacgccgacaugggcuacuggaucgagucccagaagaacgggagcuggaagcuggagaaggccucccugaucgaggucaagaccugcaccuggcccaagagccacacgcucugguccaacggcgugcuggagagcgacaugaucauccccaagucccuggccgggcccaucagccagcacaaccaccgcccgggcuaccacacccagaccgccggccccuggcaccucgggaagcuggagcuggacuucaacuacugcgagggcaccacgguggucaucaccgagaacugcgggacccggggccccucccuccgcaccacgaccgugagcgggaagcugauccacgaguggugcugccgguccugcacccugcccccgcuccgcuacaugggcgaggacggcugcugguacgggauggagauccggcccaucagcgagaaggaggagaacauggugaagagccuggucuccgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2634 - RNA, 2206 nt, Artificial Sequence
  mRNA product Design2 comprising derived and/or modified sequence from DENV-3 Consensus__SSm-EdelTM-linker-ferritin (CDS opt1) R3795/R3796
ggggcgcugccuacggagguggcagccaucuccuucucggcaucaagcuuaccaugacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccagcggcggggacaucaucaagcuccugaacgagcaggugaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacguccccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2635 - RNA, 2203 nt, Artificial Sequence
  mRNA product Design2 comprising derived and/or modified sequence from DENV-3 Consensus__SStPA-WHbcAg-linker-EdelTM  (CDS opt1) R3799/R3800
ggggcgcugccuacggagguggcagccaucuccuucucggcaucaagcuuaccauggacgccaugaagcgcggccugugcugcgugcuccugcugugcggggccgucuucguggacagcgugaccggcauggacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggcaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2636 - RNA, 5887 nt, Artificial Sequence
  mRNA product Design2 comprising derived and/or modified sequence from DENV-3 Consensus__SSc-prME-NS1-[IRES]-NS3 (CDS opt1) R3791/R3792
ggggcgcugccuacggagguggcagccaucuccuucucggcaucaagcuuaccaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacaugggcugcgugaucaacuggaaggggaaggagcugaagugcggcagcgggaucuucgucaccaacgaggugcacaccuggacggagcaguacaaguuccaggccgacucccccaagcgccucgccaccgcgaucgccggcgccugggagaacggggugugcggcauccggagcaccacccgcauggagaaccugcuguggaagcagaucgccaacgagcucaacuacauccugugggagaacaacaucaagcugacggucguggugggcgacaucaucgggguccucgagcagggcaagcggacccugaccccgcagcccauggagcugaaguacuccuggaagaccugggggaaggccaagaucgugacggcggagacccagaacagcuccuucaucaucgacggccccaacacccccgagugcccgagcgugucccgcgccuggaacgucugggagguggaggacuacggguucggcguguucaccacgaacaucuggcucaagcugcgggaggucuacacccagcugugcgaccaccgccucaugagcgccgccgugaaggacgagcgggcggugcacgccgacaugggcuacuggaucgagucccagaagaacgggagcuggaagcuggagaaggccucccugaucgaggucaagaccugcaccuggcccaagagccacacgcucugguccaacggcgugcuggagagcgacaugaucauccccaagucccuggccgggcccaucagccagcacaaccaccgcccgggcuaccacacccagaccgccggccccuggcaccucgggaagcuggagcuggacuucaacuacugcgagggcaccacgguggucaucaccgagaacugcgggacccggggccccucccuccgcaccacgaccgugagcgggaagcugauccacgaguggugcugccgguccugcacccugcccccgcuccgcuacaugggcgaggacggcugcugguacgggauggagauccggcccaucagcgagaaggaggagaacauggugaagagccuggucuccgcgugaccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauaugagcggcgugcugugggacguccccuccccgcccgagacccagaaggccgagcucgaggaggggguguaccgcaucaagcagcagggcaucuucgggaagacccaggugggcgucggggugcagaaggagggcguguuccacacgauguggcacgucacccggggcgccgugcugaccuacaacgggaagcgccuggagcccaacugggcgagcgugaagaaggaccucaucuccuacggcgggggcuggcggcugagcgcccaguggcagaagggggaggagguccaggugaucgccguggagcccggcaagaacccgaagaacuuccagaccaugcccggcacguuccagaccaccaccggggagaucggcgccaucgcccuggacuucaagcccgggacguccggcagccccaucaucaaccgcgagggcaaggucguggggcucuacggcaacgggguggucaccaagaacggcggguacguguccggcaucgcgcagaccaacgccgagccggacggccccacccccgagcuggaggaggagauguucaagaagcggaaccugacgaucauggaccuccaccccgggagcggcaagacccgcaaguaccugccggccaucgugcgggaggccaucaagcgccggcugcgcacccucauccuggcgcccacccgggucguggccgccgagauggaggaggcccugaaggggcuccccauccgcuaccagacgaccgccaccaaguccgagcacaccggccgggagaucguggaccugaugugccacgcgacguucaccaugcgccugcucagccccguccgggugccgaacuacaaccugaucaucauggacgaggcccacuucaccgaccccgccuccaucgccgcccgcggguacaucagcacccgggugggcaugggcgaggcggccgccaucuucaugacggccaccccgcccgggaccgccgacgcguucccgcaguccaacgcccccauccaggacgaggagcgcgacauccccgagcggagcuggaacuccggcaacgaguggaucaccgacuucgccgggaagacggucugguucgugcccagcaucaaggccggcaacgacaucgccaacugccugcgcaagaacgggaagaaggucauccagcucucccggaagaccuucgacaccgaguaccagaagaccaagcugaacgacugggacuucguggugacgaccgacaucagcgagaugggcgcgaacuucaaggccgaccgcgucaucgacccgcgccggugccugaagcccgugauccucaccgacggccccgagcgcgugauccuggccgggcccaugccggucaccgccgcguccgccgcccagcggcgcggccggguggggcgcaacccccagaaggagaacgaccaguacaucuucacgggccagccccugaacaacgacgaggaccacgcccacuggaccgaggccaagaugcuccuggacaacaucaacaccccggagggcaucauccccgcgcuguucgagcccgagcgggagaagagcgccgccaucgacggggaguaccgccucaagggcgagagccggaagaccuucguggagcugaugcgccggggcgaccugcccgucuggcucgcccacaagguggccuccgaggggaucaaguacaccgaccgcaaguggugcuucgacgggcagcggaacaaccagauccuggaggagaacauggacguggagaucuggacgaaggagggcgagaagaagaagcugcgcccgcgguggcucgacgcgcgcaccuacagcgacccccuggcccugaaggaguucaaggaguucgccgccggccggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2637 - RNA, 5887 nt, Artificial Sequence
  mRNA product Design2 comprising derived and/or modified sequence from DENV-3 Consensus__NS3-[IRES]- SSc-prME-NS1 (CDS opt1) R3793/R3794
ggggcgcugccuacggagguggcagccaucuccuucucggcaucaagcuuaccaugagcggcgugcugugggacguccccuccccgcccgagacccagaaggccgagcucgaggaggggguguaccgcaucaagcagcagggcaucuucgggaagacccaggugggcgucggggugcagaaggagggcguguuccacacgauguggcacgucacccggggcgccgugcugaccuacaacgggaagcgccuggagcccaacugggcgagcgugaagaaggaccucaucuccuacggcgggggcuggcggcugagcgcccaguggcagaagggggaggagguccaggugaucgccguggagcccggcaagaacccgaagaacuuccagaccaugcccggcacguuccagaccaccaccggggagaucggcgccaucgcccuggacuucaagcccgggacguccggcagccccaucaucaaccgcgagggcaaggucguggggcucuacggcaacgggguggucaccaagaacggcggguacguguccggcaucgcgcagaccaacgccgagccggacggccccacccccgagcuggaggaggagauguucaagaagcggaaccugacgaucauggaccuccaccccgggagcggcaagacccgcaaguaccugccggccaucgugcgggaggccaucaagcgccggcugcgcacccucauccuggcgcccacccgggucguggccgccgagauggaggaggcccugaaggggcuccccauccgcuaccagacgaccgccaccaaguccgagcacaccggccgggagaucguggaccugaugugccacgcgacguucaccaugcgccugcucagccccguccgggugccgaacuacaaccugaucaucauggacgaggcccacuucaccgaccccgccuccaucgccgcccgcggguacaucagcacccgggugggcaugggcgaggcggccgccaucuucaugacggccaccccgcccgggaccgccgacgcguucccgcaguccaacgcccccauccaggacgaggagcgcgacauccccgagcggagcuggaacuccggcaacgaguggaucaccgacuucgccgggaagacggucugguucgugcccagcaucaaggccggcaacgacaucgccaacugccugcgcaagaacgggaagaaggucauccagcucucccggaagaccuucgacaccgaguaccagaagaccaagcugaacgacugggacuucguggugacgaccgacaucagcgagaugggcgcgaacuucaaggccgaccgcgucaucgacccgcgccggugccugaagcccgugauccucaccgacggccccgagcgcgugauccuggccgggcccaugccggucaccgccgcguccgccgcccagcggcgcggccggguggggcgcaacccccagaaggagaacgaccaguacaucuucacgggccagccccugaacaacgacgaggaccacgcccacuggaccgaggccaagaugcuccuggacaacaucaacaccccggagggcaucauccccgcgcuguucgagcccgagcgggagaagagcgccgccaucgacggggaguaccgccucaagggcgagagccggaagaccuucguggagcugaugcgccggggcgaccugcccgucuggcucgcccacaagguggccuccgaggggaucaaguacaccgaccgcaaguggugcuucgacgggcagcggaacaaccagauccuggaggagaacauggacguggagaucuggacgaaggagggcgagaagaagaagcugcgcccgcgguggcucgacgcgcgcaccuacagcgacccccuggcccugaaggaguucaaggaguucgccgccggccggaagugaccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauaugaccagccugugccucaugaugauccugcccgccgcccuggcguuccaccucaccucccgcgacggcgagccgcggaugaucguggggaagaacgagcgcggcaagagccugcuguucaagacggccuccgggaucaacaugugcacccucaucgccauggaccugggcgagaugugcgacgacaccgucaccuacaagugcccccacaucacggagguggagcccgaggacaucgacugcuggugcaaccugaccagcaccugggugaccuacgggacgugcaaccaggccggcgagcaccggcgcgacaagcgguccgucgcccucgcgccccacgugggcauggggcuggacacccgcacccagaccuggaugagcgccgagggcgccuggcggcagguggagaaggucgagacgugggcccugcgccacccgggguucaccauccucgcgcuguuccuggcccacuacaucggcaccucccucacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccgugggcggggugcucaacagccugggcaagaugguccaccagaucuucggguccgcguacaccgcccuguucagcggcguguccugggugaugaagaucggcaucgggguccuccugaccuggaucggccugaacagcaagaacaccuccaugagcuucuccugcaucgccaucgggaucaucacgcucuaccugggcgccguggugcaggccgacaugggcugcgugaucaacuggaaggggaaggagcugaagugcggcagcgggaucuucgucaccaacgaggugcacaccuggacggagcaguacaaguuccaggccgacucccccaagcgccucgccaccgcgaucgccggcgccugggagaacggggugugcggcauccggagcaccacccgcauggagaaccugcuguggaagcagaucgccaacgagcucaacuacauccugugggagaacaacaucaagcugacggucguggugggcgacaucaucgggguccucgagcagggcaagcggacccugaccccgcagcccauggagcugaaguacuccuggaagaccugggggaaggccaagaucgugacggcggagacccagaacagcuccuucaucaucgacggccccaacacccccgagugcccgagcgugucccgcgccuggaacgucugggagguggaggacuacggguucggcguguucaccacgaacaucuggcucaagcugcgggaggucuacacccagcugugcgaccaccgccucaugagcgccgccgugaaggacgagcgggcggugcacgccgacaugggcuacuggaucgagucccagaagaacgggagcuggaagcuggagaaggccucccugaucgaggucaagaccugcaccuggcccaagagccacacgcucugguccaacggcgugcuggagagcgacaugaucauccccaagucccuggccgggcccaucagccagcacaaccaccgcccgggcuaccacacccagaccgccggccccuggcaccucgggaagcuggagcuggacuucaacuacugcgagggcaccacgguggucaucaccgagaacugcgggacccggggccccucccuccgcaccacgaccgugagcgggaagcugauccacgaguggugcugccgguccugcacccugcccccgcuccgcuacaugggcgaggacggcugcugguacgggauggagauccggcccaucagcgagaaggaggagaacauggugaagagccuggucuccgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2638 - RNA, 4630 nt, Artificial Sequence
  mRNA product Design2 comprising derived and/or modified sequence from DENV-3 Consensus__SSm-EdelTM-linker-ferritin-[IRES]-NS3 (CDS opt1) R3797/R3798
ggggcgcugccuacggagguggcagccaucuccuucucggcaucaagcuuaccaugacccagaagguggugaucuucauccugcugaugcucgucacgcccagcaugaccaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccagcggcggggacaucaucaagcuccugaacgagcaggugaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacguccccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauaugagcggcgugcugugggacguccccuccccgcccgagacccagaaggccgagcucgaggaggggguguaccgcaucaagcagcagggcaucuucgggaagacccaggugggcgucggggugcagaaggagggcguguuccacacgauguggcacgucacccggggcgccgugcugaccuacaacgggaagcgccuggagcccaacugggcgagcgugaagaaggaccucaucuccuacggcgggggcuggcggcugagcgcccaguggcagaagggggaggagguccaggugaucgccguggagcccggcaagaacccgaagaacuuccagaccaugcccggcacguuccagaccaccaccggggagaucggcgccaucgcccuggacuucaagcccgggacguccggcagccccaucaucaaccgcgagggcaaggucguggggcucuacggcaacgggguggucaccaagaacggcggguacguguccggcaucgcgcagaccaacgccgagccggacggccccacccccgagcuggaggaggagauguucaagaagcggaaccugacgaucauggaccuccaccccgggagcggcaagacccgcaaguaccugccggccaucgugcgggaggccaucaagcgccggcugcgcacccucauccuggcgcccacccgggucguggccgccgagauggaggaggcccugaaggggcuccccauccgcuaccagacgaccgccaccaaguccgagcacaccggccgggagaucguggaccugaugugccacgcgacguucaccaugcgccugcucagccccguccgggugccgaacuacaaccugaucaucauggacgaggcccacuucaccgaccccgccuccaucgccgcccgcggguacaucagcacccgggugggcaugggcgaggcggccgccaucuucaugacggccaccccgcccgggaccgccgacgcguucccgcaguccaacgcccccauccaggacgaggagcgcgacauccccgagcggagcuggaacuccggcaacgaguggaucaccgacuucgccgggaagacggucugguucgugcccagcaucaaggccggcaacgacaucgccaacugccugcgcaagaacgggaagaaggucauccagcucucccggaagaccuucgacaccgaguaccagaagaccaagcugaacgacugggacuucguggugacgaccgacaucagcgagaugggcgcgaacuucaaggccgaccgcgucaucgacccgcgccggugccugaagcccgugauccucaccgacggccccgagcgcgugauccuggccgggcccaugccggucaccgccgcguccgccgcccagcggcgcggccggguggggcgcaacccccagaaggagaacgaccaguacaucuucacgggccagccccugaacaacgacgaggaccacgcccacuggaccgaggccaagaugcuccuggacaacaucaacaccccggagggcaucauccccgcgcuguucgagcccgagcgggagaagagcgccgccaucgacggggaguaccgccucaagggcgagagccggaagaccuucguggagcugaugcgccggggcgaccugcccgucuggcucgcccacaagguggccuccgaggggaucaaguacaccgaccgcaaguggugcuucgacgggcagcggaacaaccagauccuggaggagaacauggacguggagaucuggacgaaggagggcgagaagaagaagcugcgcccgcgguggcucgacgcgcgcaccuacagcgacccccuggcccugaaggaguucaaggaguucgccgccggccggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2639 - RNA, 4627 nt, Artificial Sequence
  mRNA product Design2 comprising derived and/or modified sequence from DENV-3 Consensus__SStPA-WHbcAg-linker-EdelTM-[IRES]-NS3 (CDS opt1) R3801/R3802
ggggcgcugccuacggagguggcagccaucuccuucucggcaucaagcuuaccauggacgccaugaagcgcggccugugcugcgugcuccugcugugcggggccgucuucguggacagcgugaccggcauggacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcaggugcgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcggcgggggcgggagcggcgggggcggcaugcggugcgugggggugggcaaccgcgacuucgucgagggccuguccggggccaccuggguggacgugguccuggagcacggcgggugcgugaccacgauggccaagaacaagcccacccucgacaucgagcugcagaagaccgaggccacccagcuggcgacgcuccggaagcugugcaucgagggcaagaucaccaacaucaccaccgacagccgcugccccacgcagggcgaggccacccugccggaggagcaggaccagaacuacgugugcaagcacaccuacgucgaccggggguggggcaacgggugcggccucuucgggaagggcucccuggugaccugcgccaaguuccagugccuggagcccaucgagggcaaggugguccaguacgagaaccucaaguacacggugaucaucaccgugcacaccggggaccagcaccaggucggcaacgagacccagggggugacggccgagaucaccccgcaggccagcaccaccgaggcgauccugcccgaguacggcacccuggggcucgagugcuccccgcgcacgggccuggacuucaacgagaugauccugcucaccaugaagaacaaggccuggaugguccaccggcagugguucuucgaccugccccugcccuggaccagcggcgccaccacggagacccccaccuggaaccgcaaggagcuccuggugaccuucaagaacgcccacgccaagaagcaggagguggucgugcuggggucccaggagggcgcgaugcacacggcccucaccggggccaccgagauccagaacagcggcgggaccuccaucuucgccggccaccugaagugccggcugaagauggacaagcucgagcugaagggcaugagcuacgccaugugcacgaacaccuucgugcugaagaaggaggucuccgagacccagcacgggaccauccugaucaagguggaguacaagggcgaggacgugccgugcaagauccccuucagcacggaggacgggcagggcaaggcgcacaacggccgccucaucaccgccaaccccgucgugaccaagaaggaggagcccgugaacaucgaggccgagccgcccuucggggagagcaacaucgucaucggcaucggggacaacgcccugaagaucaacugguacaagaagggcuccagcaucgggaagauguucgaggcgaccgcccggggcgcccgccggauggccauccugggcgacacggccugggacuucggguccugaccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacauguguuuagucgagguuaaaaaacgucuaggccccccgaaccacggggacgugguuuuccuuugaaaaacacgaugauaauaugagcggcgugcugugggacguccccuccccgcccgagacccagaaggccgagcucgaggaggggguguaccgcaucaagcagcagggcaucuucgggaagacccaggugggcgucggggugcagaaggagggcguguuccacacgauguggcacgucacccggggcgccgugcugaccuacaacgggaagcgccuggagcccaacugggcgagcgugaagaaggaccucaucuccuacggcgggggcuggcggcugagcgcccaguggcagaagggggaggagguccaggugaucgccguggagcccggcaagaacccgaagaacuuccagaccaugcccggcacguuccagaccaccaccggggagaucggcgccaucgcccuggacuucaagcccgggacguccggcagccccaucaucaaccgcgagggcaaggucguggggcucuacggcaacgggguggucaccaagaacggcggguacguguccggcaucgcgcagaccaacgccgagccggacggccccacccccgagcuggaggaggagauguucaagaagcggaaccugacgaucauggaccuccaccccgggagcggcaagacccgcaaguaccugccggccaucgugcgggaggccaucaagcgccggcugcgcacccucauccuggcgcccacccgggucguggccgccgagauggaggaggcccugaaggggcuccccauccgcuaccagacgaccgccaccaaguccgagcacaccggccgggagaucguggaccugaugugccacgcgacguucaccaugcgccugcucagccccguccgggugccgaacuacaaccugaucaucauggacgaggcccacuucaccgaccccgccuccaucgccgcccgcggguacaucagcacccgggugggcaugggcgaggcggccgccaucuucaugacggccaccccgcccgggaccgccgacgcguucccgcaguccaacgcccccauccaggacgaggagcgcgacauccccgagcggagcuggaacuccggcaacgaguggaucaccgacuucgccgggaagacggucugguucgugcccagcaucaaggccggcaacgacaucgccaacugccugcgcaagaacgggaagaaggucauccagcucucccggaagaccuucgacaccgaguaccagaagaccaagcugaacgacugggacuucguggugacgaccgacaucagcgagaugggcgcgaacuucaaggccgaccgcgucaucgacccgcgccggugccugaagcccgugauccucaccgacggccccgagcgcgugauccuggccgggcccaugccggucaccgccgcguccgccgcccagcggcgcggccggguggggcgcaacccccagaaggagaacgaccaguacaucuucacgggccagccccugaacaacgacgaggaccacgcccacuggaccgaggccaagaugcuccuggacaacaucaacaccccggagggcaucauccccgcgcuguucgagcccgagcgggagaagagcgccgccaucgacggggaguaccgccucaagggcgagagccggaagaccuucguggagcugaugcgccggggcgaccugcccgucuggcucgcccacaagguggccuccgaggggaucaaguacaccgaccgcaaguggugcuucgacgggcagcggaacaaccagauccuggaggagaacauggacguggagaucuggacgaaggagggcgagaagaagaagcugcgcccgcgguggcucgacgcgcgcaccuacagcgacccccuggcccugaaggaguucaaggaguucgccgccggccggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2640 - protein, 3292 aa, Artificial Sequence
  derived and/or modified protein sequence (wt) from DENV-1__AB608789__SS-prME
SVTMLLMLMPTALAFHLTTRGGEPHMIVTKQERGKSLLFKTSAGVNMCTLIAMDLGELCEDTMTYKCPRITEAEPDDIDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKRGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCMSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTVSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDEGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGVKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAPESRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSSSELETPNLAERVLDWLGKYGVERLKRMAISGDDCVVKPIDDRFATALTALNDVGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWATNIQVAINQVRRLIGNENYLDYMTSMKRFKNESDPEGALW

SEQ ID NO: 2641 - protein, 3292 aa, Artificial Sequence
  derived and/or modified protein sequence (wt) from DENV-1__AB608788__SS-prME
SVTMLLMLLPTVLAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGATTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRVITANPIVTDKEKPVNIEAEPPFGESYIVVGAGEKALKLSWFKKGSTIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGYVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTSGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWAALLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGAGHEEPIPMATYGWNLVKLYSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVRLLTKPWDVIPMVTQIAMTDTTPFGQQRVFKEKVDTRTPKAKQGTAQVMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHRLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTENMLSVWNRVWIEENPWMEDKTHVSSWEDVPYLGKREDQWCGSLIGLTARATWATNIQVAINQVRRLIGNENYLDYMTSMKRFKNDSDPEGALW

SEQ ID NO: 2642 - protein, 3292 aa, Artificial Sequence
  derived and/or modified protein sequence (wt) from DENV-1__AB608786__SS-prME
SVTMLLMLMPTALAFHLTTRGGEPHMIVSKQERGKSLLFKTSAGVNMCTLIAMDLGELCEDTMTYKCPRITETEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSLAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIIIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKGSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2643 - protein, 3292 aa, Artificial Sequence
  derived and/or modified protein sequence (wt) from DENV-1__AB608787__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIVHEWCCRSCTLPPLRFRGEDGCWYGMEIRPVKEKEENLVKSMVSAGSGEVDSFSLGLLCISIIIEEVMRSRWIRKMLMTGTLGVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKGSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWSFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARPTWATNIQVAINQVRRLIGNENYLDYMTSMKRFKNESEPEGALW

SEQ ID NO: 2644 - protein, 3292 aa, Artificial Sequence
  derived and/or modified protein sequence (wt) from DENV-1__HE795086__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRKDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGVRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQDGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKYEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2645 - protein, 3292 aa, Artificial Sequence
  derived and/or modified protein sequence (wt) from DENV-1__AB189120__SS-prME
SVTMLLMLLPTVLTFHLTTRGGEPHMIVSKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEAVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKTIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLVVFLLLTLGQLTWNDLIRLCIMVGANASDNMGMGTTYLALMATFRMRPMFAVGLLFRRLTSREVLLLTVGLSLVASVELPNSLEELGDGLAMGIMILKLLTDFQSHQLWATLLSLTFVKTTLSLHYAWKTMAMILSIVSLLPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAKVSWEEEAEHSGASHNILVEIQDDGTMKIKDEERDDTITILLKATLLAISGVYPMSIPATLFVWYFWQKKKQRSGVLWDTPSPPEVEKAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETIMLLALIAVLTGGVTLFFLSGRGLGKTSIGLLCVMSSSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAGRVLDWLEKHGTERLRRMAISGDDCVVKPIDDRFATALTALNDMGKIRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2646 - protein, 3292 aa, Artificial Sequence
  derived and/or modified protein sequence (wt) from DENV-1__AB189121__SS-prME
SVTMLFMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWRQIQKVETWALRHPGFTVMALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTAIITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVIQNGRLITANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNITFIIDGPNTSECPDNQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPVSQHNYRPGYFTQTAGPWHLGKLELDFDLCEGTTVVVDENCGNRGPSLRTTTVTGKTIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDMMGMGTTYLALMATFRMRPMFAVGLLFRRLTSREVLLLTVGLSLVASVELPNSLEELGDGLAMGIMMLKLLTDFQPHQLWATLLSLTFVKTTFSLHYAWKTMAMILSIVSLLPLCLSTTSQKTTWLPVLLGSLGCKPLTMLLITENKIWGRRSWPLNEGIMAIGIVSILLSSLLKNDVPLAGPLIAGGMLIACYVISGSSADLSLEKAAEVSWEDEAEHSGASHNILVEVQDDGTMKIKDEERDDTLTILLKATLLAISGVYPMSIPATLFVWYFWQKKKQRSGVLWDTPSPPEVERAVLDNGIYRILQRGLLGRSQVGVGVFQEGVFHTMWHVTRGAVLMYQGKRLEPSWASVKRDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYEWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNPNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEKMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVFDWLEKHGIERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2647 - protein, 3292 aa, Artificial Sequence
  derived and/or modified protein sequence (wt) from DENV-1__AB195673__SS-prME
SVTMLLMLLPTALTFHLTTRGGEPHMIVGKQERGKSLLFKTSAGVNMCTLIAMDLGELCDDTMTYKCPRITETEPDDVDCWCNATETWVTYGTCSQTGEHRRDKRSVALAPHVGLGLETRTETWMSSEGAWRQIQKVETWALRHPGFTVIALFLAHVIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGISYVMCTGSFKLEKEVAETQHGTVLVQVKYEGTDAPCKIPFSSQDEKGVTQNGRLVTANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGLITLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKSIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDNMGMGTTYLALMATFRMRPMFAVGLLFRRLTSREVLLLTVGLSLVASVELPNSLEELGDGLAMGIMILKLLTDFQSHQLWATLLSLTFVKTTFSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEIQDDGTMKIKDEERDDTITILLKATLLAISGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMSSSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIVEVDRSEAKEGLKRGETIKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVRRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMGAQLIRQMESEGIFSPSELETPNLAGRVLDWLEKHGIERLRRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2648 - protein, 3292 aa, Artificial Sequence
  derived and/or modified protein sequence (wt) from DENV-1__AB204803__SS-prME
SVTMLLMLLPTVLTFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCVKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGPFKLEKEVAETQHGTVLVQVKYEGTDAPCKIPFSSQDEKGVTQNGRLITANPIVTDKEKPINIEAEPPFGESYIVVGVGEKALKLSWFKKGSSIGKMFEATARGARRMAILGDTAWDFGSIGGVFTSMGKLVHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNTTFIIDGPNTPECSDDQRAWNIWEVEDYGFGIFTTNIWLKLRDSYTQVCDHRLMSAAIKDSRAVHADMGYWIESEKNETWKLARASFIEVKTCIWPKSHTLWSNGVLESEMIIPKIYGGPISQHNYRPGYFTQTAGPWHLGKLELDFDLCEGTTVVVDEQCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLTMGQLTWNDLIRLCIMVGANASDKMGMGTTYLALMATFRMRPMFAVGLLFRGLTSREVLLLTVGLSLVASVELPNSLEELGDGLAMGIMMLKLLTDFQSHQLWATLLSLTFVKTTFSLHYAWKTMAMTLSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTITILLKATLLAISGVYPMSIPATLFVWYFWQKKKQRSGVLWDTPSPPEVERAVLDDGIYRILQRGLLGRSQVGVGVFQEGVFHTMWHVTRGAVLMYQGKRLEPSWASVKKDLISYGGGWRFQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQTALDNLVMLHNSEQGGKAYRHAMEELPDTIETLMLLALIAVLTGGVTLFFLSGKGLGKTSIGLLCVMSSSALLWMASVEPHWIAASIILEFFLMVLLIPEPDRQRTPQDNQLAYVVIGLLFMILTVAANEMGLLETTKKDLGIGHAAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVRPSGSASSMVNGVVRLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEAQLIRQMESEGIFSPSELETPNLAGRVLDWLEKHGIERLKRMAISGDDCVVKPIDDRFATALTALNDMGKVRKDIPQWEPSKGWNDWQQVPFCSHHFHQLIMKDGREIVVPCRSQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2649 - protein, 3292 aa, Artificial Sequence
  derived and/or modified protein sequence (wt) from DENV-1__LC016760__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRYRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTIAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPVPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVAVEPEVANLDIIGQRIENIKCEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITEIMEPEHAQLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMKDKTHISSWEDVPYLGKREDQWCGSLIGLTARATWATNIQVAINQVRRLIGNENYLDYMTSMKRFKNESDPEGALW

SEQ ID NO: 2650 - protein, 3292 aa, Artificial Sequence
  derived and/or modified protein sequence (wt) from DENV-1__LC128301__SS-prME
SVTMLLMLLPTALAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDEKGVTQNGRLITANPIVTDKEKPVNIEAEPPFGESYLVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVNGILAQGKKMIRPQPMEHKYSWKSWGKAKVIGADVQNTTFIIDGPNTPECPDDQRAWNIWEVEDYGFGIFTTNIWLKLRDSYTQVCDHRLMSAAIKDSKAVHADMGYWIESEKNETWKLTRASFIEVKTCIWPKSHTLWSNGVLESEMIIPKTYGGPISQHNYRPGYFTQTAGPWHLGKLELDFGLCEGTTVVVDEHCGNRGPSLRTTTVTGKIIHEWCCRSCTLPPLRFKGEDGCWYGMEIRPVKEKEENLVRSMVSAGSGEVDSFSLGLLCISIMIEEVMRSRWSRKMLMTGTLAVFLLLIMGQLTWNDLIRLCIMVGANASDKMGMGTTYLALMATFRMRPMFAVGLLFRRLTSREVLLLTVGLSLVASVELPNSLEELGDGLAMGIMMLKLLTDFQSHQLWAALLSLTFVKTTFSLHYAWKTMAMILSIISLFPLCMSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGKSQVGVGVFQEGVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSMEAFPQSNAAIQDEERDIPERSWNSGYDWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAAESHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKVLNPYMPSVVETLEQMQRKHGGMLVRNPLSRNSTHEMYWVSCGTGNIVSAVNMTSRMLLNRFTMTHRKPTYEKDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGTERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2651 - protein, 3292 aa, Artificial Sequence
  derived and/or modified protein sequence (wt) from DENV-1__LC011945__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRYRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTIAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGSERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPVPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVAVEPEVANLDIIGQRIENIKCEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITEIMEPEHAQLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMKDKTHISSWEDVPYLGKREDQWCGSLIGLTARATWATNIQVAINQVRRLIGNENYLDYMTSMKRFKNESDPEGALW

SEQ ID NO: 2652 - protein, 3292 aa, Artificial Sequence
  derived and/or modified protein sequence (wt) from DENV-1__LC011949__SS-prME
SVTMLLMLVPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADTGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFLPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2653 - protein, 3292 aa, Artificial Sequence
  derived and/or modified protein sequence (wt) from DENV-1__HM469966__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVVLAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWIASVEPHWIAASIILEFFLMVLLIPEPDRQRTPQDNQLAYVVIGLLFMILTVAANEMGLLETTKKDLGIGHVAVENHHHAAILDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWKGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2654 - protein, 3292 aa, Artificial Sequence
  derived and/or modified protein sequence (wt) from DENV-1__JX669462__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWRQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATLKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2655 - protein, 3292 aa, Artificial Sequence
  derived and/or modified protein sequence (wt) from DENV-1__JX669463__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWRQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATLKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2656 - protein, 3292 aa, Artificial Sequence
  derived and/or modified protein sequence (wt) from DENV-1__JX669464__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEMDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKIPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFLPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2657 - protein, 3292 aa, Artificial Sequence
  derived and/or modified protein sequence (wt) from DENV-1__JX669465__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIRPQPMEHKYSWKSWGKAKIIGADTQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKTYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEMDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKIRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2658 - protein, 3292 aa, Artificial Sequence
  derived and/or modified protein sequence (wt) from DENV-1__JX669466__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWRQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTILVQVKYEGTDAPCKIPFSTQDEKGVTQNGRLITANPIVTDKEKPVNIETEPPFGESYIVVGAGEKALKLSWFKRGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADLGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGVFTTNIWLKLRDSYTQMCDHRLMSAAIKDSKAVHADMGYWIESEKNETWKLARASFIEVKTCTWPKSHTLWSNGVLESEMIIPKIFGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERALDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPASRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2659 - protein, 3292 aa, Artificial Sequence
  derived and/or modified protein sequence (wt) from DENV-1__JX669467__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTATVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2660 - protein, 3292 aa, Artificial Sequence
  derived and/or modified protein sequence (wt) from DENV-1__HM469967__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPKVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEIGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKAGNDIANCLRKNGKRVIQLSRKTFDTEYQKTKNSDWDYVVTTDISEMGANFRADRVIDPRRCLKPVILKDGPERVILAGPMPVTVASAAQRRGRVGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWKGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLKWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRKNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQKVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2661 - protein, 3292 aa, Artificial Sequence
  derived and/or modified protein sequence (wt) from DENV-1__JX669468__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGNGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTATVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2662 - protein, 3292 aa, Artificial Sequence
  derived and/or modified protein sequence (wt) from DENV-1__JX669469__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIKAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMAQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATILDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2663 - protein, 3292 aa, Artificial Sequence
  derived and/or modified protein sequence (wt) from DENV-1__JX669470__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIVVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYLWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLRNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2664 - protein, 3292 aa, Artificial Sequence
  derived and/or modified protein sequence (wt) from DENV-1__JX669471__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATLKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTVPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYDRDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2665 - protein, 3292 aa, Artificial Sequence
  derived and/or modified protein sequence (wt) from DENV-1__JX669472__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDMKFTVVVGNANGILAQGKKMIKPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTATVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2666 - protein, 3292 aa, Artificial Sequence
  derived and/or modified protein sequence (wt) from DENV-1__JX669473__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPSSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDMKFTVVVGNANGILAQGKKMIKPQPMEHKYSWKSWGKAKIIGADIQNATFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTATVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2667 - protein, 3292 aa, Artificial Sequence
  derived and/or modified protein sequence (wt) from DENV-1__JX669474__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDMKFTVVVGNANGILAQGKKMIKPQPMEHKYSWKSWGKAKIIGADIQNATFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPTSQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTATVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAISGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2668 - protein, 3292 aa, Artificial Sequence
  derived and/or modified protein sequence (wt) from DENV-1__JX669475__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDIKFTVVVGNANGILAQGKKMIRPQPMEHKYSWKSWGKAKIIGADIQNTTFIIDGPDTPECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPISQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDKMGMGTTYLALMATFKMRPMFAVGLSFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFFPSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2669 - protein, 3292 aa, Artificial Sequence
  derived and/or modified protein sequence (wt) from DENV-1__JX669461__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEMDSFSLGILCVSILIEEVMRSRWSRKMLMTGTLAVFLLLIMGQLTWNDLIRLCIMVGANASDKMGMGTTYLALMATLKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2670 - protein, 3292 aa, Artificial Sequence
  derived and/or modified protein sequence (wt) from DENV-1__KF184975__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTEDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSIQDEKGVIQNGRLITANPIVTDKEKPVNIETEPPFGESYIVVGAGEKTLKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENVMWKQISNELNHILLENDMKFTVVVGDVNGILAQGKKMVRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVRSMVSAGSGEVDNFSLGLLCVSIMVEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTDFQSHQLWTTLLSLTFVKTTLSLDYAWKTMAMVLSIVSLFPLCLSTTSQKTTWLPVLLGSFGCKPLTMFLITENKIWGRKSWPLNEGIMAVGIASILLSSLLKNDVPLAGPLIAGGMLIACYVISGSSADLSLEKAAEVSWEEEAEHSGASHNILVEVQDDGTMKIKDEERDDTLTILLKATLLAVSGVYPMSIPATLFVWYFWQKKKQRSGVLWDTPSPPEAEKAVLDDGIYRILQRGLLGRSQVGVGVFQDGVFHTMWHVTRGAVLMYQGKRVEPSWASVKKDLISYGGGWRFQGLWNTGEEVQVIAVEPGKNPRNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKTEHTGREIVDLMCHATFTMRLLSPVRVPNYNMIIMDEAHFTDPASIAARGYISTRVGMGEAAAIFMTATPPGSMEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGRLPQHLTLKAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFIILTVAANEMGLLETTKKDLGIGHVAAEDHQHATMLDVDLRPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGITEVDRSEAKEGLKRGETTKHAVSRGAAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFLPSELETPNLAERALDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2671 - protein, 3292 aa, Artificial Sequence
  derived and/or modified protein sequence (wt) from DENV-1__KT831765__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNHRPGYFTQTAGPWHLGKLELDFDLCEGTTVVVDEHCGNRGPSLRTTTVTGKIIHEWCCRSCTLPPLRYRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGMLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVTVEPEVANLDIIGQRIENIKCEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITEIMEPEHAQLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2672 - protein, 3292 aa, Artificial Sequence
  derived and/or modified protein sequence (wt) from DENV-1__KP188567__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIKPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANALDRMGMGTTYLALMATFKMRPMFAVGLLFRRLTSREVLLLTVGLSLVASVELPSSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGTLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPADWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2673 - protein, 3292 aa, Artificial Sequence
  derived and/or modified protein sequence (wt) from DENV-1__KP188568__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEMDSFSLGILCVSILIEEVMRSRWSRKMLMTGTLAVFFLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPSIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAAIQDEERDIPERSWNTGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWVASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSVMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2674 - protein, 3292 aa, Artificial Sequence
  derived and/or modified protein sequence (wt) from DENV-1__KF971870__SS-prME
SVTMLLMLMPTALAFHLTTRGGEPHMMVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSSAIKDSKAVHADMGYWIESEKNDTWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMIGTLAVFFLLIMGQLTWNDLIRLCIMVGANASDRMGMGTTYLALMATFKMRPMFAVGLLFRRLTSREVLLLTIGLSLVASAELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVFPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGEREKLRPRWLGARTYSDPLALRDFKEFAAGRRSVSGDLILEIGKLPQHLTQRAQNALDNLVMLHNSQQGGRAYTHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRRLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISNWEDVPYLGKREDQWCGSLIGLTARATWATNIQVAINQVRRLIGNENYLDYMTSMKRFKNESDPEGALW

SEQ ID NO: 2675 - protein, 3292 aa, Artificial Sequence
  derived and/or modified protein sequence (wt) from DENV-1__KF971871__SS-prME
SVTMLLMLMPTALAFHLTTRGGEPHMMVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNDTWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMIGTLAVFFLLIMGQLTWNDLIRLCIMVGANASDRMGMGTTYLALMATFKMRPMFAVGLLFRRLTSREVLLLTIGLSLVASAELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVFPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLGARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRRLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISNWEDVPYLGKREDQWCGSLIGLTARATWATNIQVAINQVRRLIGNENYLDYMTSMKRFKNESDPEGALW

SEQ ID NO: 2676 - protein, 3292 aa, Artificial Sequence
  derived and/or modified protein sequence (wt) from DENV-1__KF971869__SS-prME
SVTMLLMLMPTALAFHLTTRGGEPHMMVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNDTWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMIGTLAVFFLLIMGQLTWNDLIRLCIMVGANASDRMGMGTTYLALMATFKMRPMFAVGLLFRRLTSREVLLLTIGLSLVASAELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVFPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRRLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISNWEDVPYLGKREDQWCGSLIGLTARATWATNIQVAINQVRRLIGNENYLDYMTSMKRFKNESDPEGALW

SEQ ID NO: 2677 - protein, 3292 aa, Artificial Sequence
  derived and/or modified protein sequence (wt) from DENV-1__JN903578__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKVVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLIQDEKGVTQNGRLITANPIVTDKEKPVNIETEPPFGESYIVVGAGEKALKLSRFKKGSSIGKMFEATARGARRMAILGDTAWDFGSIGGVFTSVGKLIHQVFGTAYGVLFSGVSWTMKIGIGILLTWLGLNSRSTSLSMTCITVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEIKTCIWPKSHTLWSNGVLESEMIIPKIYGGPISQHNHRPGYFTQTAGPWHLGKLELDFDVCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASAELPNSLEELGDGLAMGIMMLKLLTDFQSHQLWTTLLSLTFIKTTLSLDYAWKTITMILSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEEKDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDGDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGSRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFLPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTTMKRFKNESDPEGALW

SEQ ID NO: 2678 - protein, 3292 aa, Artificial Sequence
  derived and/or modified protein sequence (wt) from DENV-1__JN903579__SS-prME
SVTMLLMLLPTALAFHLTTRGGEPHMIVGKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADTGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASAELPNSLEELGDGLAMGIMMLKLLTDFQSHQLWTTLLSLTFIKTTLSLDYAWKTIAMILSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTIDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGSLFMILTVAANEMGLLETTKKDLGIGHVVAENHHHATTLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLYKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYSDYTTSMKRFKNESDPEGALW

SEQ ID NO: 2679 - protein, 3292 aa, Artificial Sequence
  derived and/or modified protein sequence (wt) from DENV-1__JN903580__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRNTSLSMTCIAVGMVTLYLGVMVQADTGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMKSRWSRKMLMTGTLAVFFLLIMGQLTWNDLIRLCIMVGANVSDRMGMGTTYLALMATFKMRPMFAVGLLFRRLTSREVLLLTIGLSLVASAELPNSLEELGDGLAMGIMMLKLLTDFQSHQLWTTLLSLTFIKTTLSLDYAWKTIAMILSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGRSQVGVGVFQDGVFRTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRDTGAQGETLGEKWKRQLNQLSKPEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRMENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLYKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYSDYMTSMKRFKNESDPEGALW

SEQ ID NO: 2680 - protein, 3292 aa, Artificial Sequence
  derived and/or modified protein sequence (wt) from DENV-1__JN903581__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRNTSLSMTCIAVGMVTLYLGVMVQADTGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGIFTTNIWLKLRDSYTQMCDHRLMSAVIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEEEENLVRSMVSAGSGEVDSFSLGLLCVSIMIEEVMKSRWSRKMLMTGTLAVFFLLIMGQLTWNDLIRLCIMVGANVSDRMGMGTTYLALMATFKMRPMFAVGLLFRRLTSREVLLLTIGLSLVASAELPNSLEELGDGLAMGIMMLKLLADFQSHQLWTTLLSLTFIKTTLSLDYAWKTIAMILSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGDGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLEPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKRDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTVKLRWFVERNLVKPEGKVIDLGCGRGGWSYYCAGLKKVTEVKGYTKGGPGHEEPIPMATYGWNIVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLYKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYSDYMTSMKRFKNESDPEGALW

SEQ ID NO: 2681 - protein, 3292 aa, Artificial Sequence
  derived and/or modified protein sequence (wt) from DENV-1__KX380796__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQMQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKTVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFNGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQPHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGRFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2682 - protein, 3292 aa, Artificial Sequence
  derived and/or modified protein sequence (wt) from DENV-1__KX380799__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGRFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2683 - protein, 3292 aa, Artificial Sequence
  derived and/or modified protein sequence (wt) from DENV-1__KX380800__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAIFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2684 - protein, 3292 aa, Artificial Sequence
  derived and/or modified protein sequence (wt) from DENV-1__KX380802__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMGKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2685 - protein, 3292 aa, Artificial Sequence
  derived and/or modified protein sequence (wt) from DENV-1__KX380797__SS-prME
SVTVLLMLLPTALAFHLTTRGGEPHMIVSKQERGKSLLFKTSTGVNMCTLIAMDLGELCEDTMTYKCPRITETEPDDVDCWCNATETWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTLVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFTSQDEKGVTQNGRLITANPIVTDKEKPVNIEAEPPFGESYLVVGAGEKALKLSWFKKGSSIGKMFEATARGARRMAILGDTAWDFGSIGGVFTSVGKLIHQIFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVNGILAQGKKMIRPQPMEHKYSWKSWGKAKVIGADVQNSTFIIDGPNTPECPDDQRAWNIWEVEDYGFGIFTTNIWLKLRDSYTQVCDHRLMSAAIKDSKAVHADMGYWIESEKNETWKLTRASFIEVKTCVWPKSHTLWSNGVLESEMIIPKIYGGPISQHNYRPGYFTQTAGPWHLGKLELDFGLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDKMGMGTTYLALMATFRMRPMFAVGLLFRRLTSREVLLRSVGLSLVASVELPNSLEELGDGLAMGIMMLKLLTDFQSHQLWAALLSLTFVKTTFSLHYAWKTMAMILSIVSLFPLCLSTTSQKTTWLPVLLGSLGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPMSIPATLFVWYFWQKKKQRSGVLWDTPSPPEVERAVLDDGIYRILQRGLLGKSQVGVGVFQEGVFHTMWHVTRGAVLMYQGKRLEPSWASVKKDLISYGGGWRFQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLVLAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSMEAFPQSNAAIQDEERDIPERSWNSGYDWITDFPGKTVWFVPSIKSGNDIANCLRKNGKRVVQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGKAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAAESHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLTKSEFNTYKRSGIIEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFTPPEKCDTLLCDIGESSPNPTIEEGRTLRVLKMVEPWLRGNQFCIKVLNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKYGIERLKRMAISGDDCVVKPVDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2686 - protein, 3292 aa, Artificial Sequence
  derived and/or modified protein sequence (wt) from DENV-1__KX380805__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPISTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADTQNTTFIIDGPDTPECPDDQRAWNIWEVEDYGFGVFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFNLCEGTTVVVDEHCGNRGPSLRTTTVTGKIIHEWCCRSCTLPPLRFRGEDGCWYGMEIRPVKEKEENLVRSMVSAGSGEVDSFSLGLLSVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLERAAEVSWEEEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNIVKLHSGRDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2687 - protein, 3292 aa, Artificial Sequence
  derived and/or modified protein sequence (wt) from DENV-1__KX380798__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2688 - protein, 3292 aa, Artificial Sequence
  derived and/or modified protein sequence (wt) from DENV-1__KJ649286__SS-prME
SVTMLLMLLPTVLAFHLTTRGGEPHMIVTKQERGKSLLFKTSTGVNMCTLIAMDLGELCEDTMTYKCPRITEAEPDDIDCWCNATDTWVTYGTCSQTGEHRRDKRSVALAPHVGLGLETRTETWMSSEGAWKQIQRVETWALRHPGFTVTALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGATTSQETWNRQDLLVTFKTAHAKKQEVVVLGSQEGAMHTALTGATEIQTSGTTTIFAGHLKCRLKMDKLTLKGMSYVMCTGSFKLEKEVVETQHGTVLVQVKYEGTDAPCKIPFLTQDEKGVTQNGRVITANPIVTDKEKPVNIEAEPPFGESYIVVGAGEKALKLSWFKKGSTIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVSGILAQGKKMIRPQPMEHKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWAALLSLTFIKTTCSLHYAWKTMAMVLSIVSLFPLCMSTTSQKTTWLPVLLGSLGCKPLTMFLIAENKIWGRKSWPLNEGIMAVGIVSILLSSLLKNDVPLAGPLVAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYKGKRLEPTWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQSALDNLVMLHNSEQGGRAYRHAMEELPDTIETLMLLALIAVLTGGVTLFFLSGKGLGKTSIGLLCVMASSMLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPMTLTAAVLMLVAHYTIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIIEVDRSEAKEGLKRGETTKHAVSRGTAKLRWFVERNLVKPEGKVIDLGCGRGGWSYYCAGLKKVTEVKGYTKGGAGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVRLLTKPWDVIPMVTQIAMTDTTPFGQQRVFKEKVDTRTPKAKRGTAQVMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHRLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGLFSPSELETPNLAERVLNWLGKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTENMLSVWNRVWIEENPWMEDKTHVSSWEDVPYLGKREDQWCGSLIGLTARATWATNIQVAINQVRKLIGNENYLDYMTSMKRFKNDSDPEGALW

SEQ ID NO: 2689 - protein, 3292 aa, Artificial Sequence
  derived and/or modified protein sequence (wt) from DENV-1__KF887994__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMLEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIIGQLTWNDLIRLCIMVGANASDRMGMGTTYLALMATFKMRPMFAVGLLFRRLTSREVLLLTIGLSLMASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWYYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSFSGVEGEGLHKLGYILRDISKIPGGNMYADDTAGWDTRITEDDLQNEARITDIMEPEHALLAKSIFKLTYQNKVVRVQRPAKNGTVMDVVSRRDQRGSGQVGTYGLNTFTNMEAQLIRQMESEGIFSPSELETPNLAERVLAWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVNWIPTSRTTWSIHAHHQWMTTEDMLSVWNRVWIEENPWMEDKTHISSWGDVPYLGKREDQWCGSLIGLTARATWATNIQVAINQVRKLIGNENYLDYMTSMKRFKNESDPEGALW

SEQ ID NO: 2690 - protein, 3292 aa, Artificial Sequence
  derived and/or modified protein sequence (wt) from DENV-1__JQ675358__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKTYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSLLLSSLLKNDVPLAGPLIAGGMLIACYVISGSSADLSLEKAAEVSWEQEAEHSGTSHNILVEVQDDGTMKIKDEERDDTLTILVKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPRKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDTKFEKQLGQIMLLILCTSQILLMRTTWALCESITLATGPLTTLWEGSPGKFWNTTIAVSMANIFRGSYLAGAGLAFSLMKSVGGGRRGMGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLHTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2691 - protein, 3292 aa, Artificial Sequence
  derived and/or modified protein sequence (wt) from DENV-1__FJ850070__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAASGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLHPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKSSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2692 - protein, 3292 aa, Artificial Sequence
  derived and/or modified protein sequence (wt) from DENV-1__FJ850071__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFFLLIMGQLTWNDLIRLCIMVGANASDRMGMGTTYLALMATFKMRPMFAVGLLFRKLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2693 - protein, 3292 aa, Artificial Sequence
  derived and/or modified protein sequence (wt) from DENV-1__FJ850073__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGRAWEEGVCGIRSATRLENIMWKQISNELNHILLENDIKFTVVVGNADGILAQGKKMIRPQPMEHKYSWKSWGKAKIIGADIQNTTFIIDGPDTLECPDEQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKMYGGPVSQHNYRPGYFTQTAGPWHLGKLELDFDLCEGTTVVVDEHCGSRGPSLRTTTVTGKIIHEWCCRSCTLPPLRFRGEDGCWYGMEIRPVKEKEENLVRSMVSAGSGEVDSFSLGVLCVSIMIEEVMRSRWSRKMLMTGTLAVFLLLIMGQLTWNDLIRLCIMVGANASDKMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENEIWGRKSWPLNEGIMAIGIVSILLSSLLKNDVPLAGPLIAGGMLIACYVISGSSADLSLEKAAEVSWEEEVEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALMAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHQHATMLDVDLHPASAWTLYAVATTVITPMMRHTIENTTANISLTAIANQAAILMGLDKGWPISKMDLGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLRNEAKITDIMEPEHALLATSIFKLTYQNKVVRVQRPAKNGTVMDVISRRDQRGSGQVGTYGLNTFTNMEVQLIRQMESEGIFFSSELESPNLAERVLDWLEKHGAERLKRMAISGDDCVVKPIDDRFATALIALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNGNYLDYMTSMKRFKNESDPEGALW

SEQ ID NO: 2694 - protein, 3292 aa, Artificial Sequence
  derived and/or modified protein sequence (wt) from DENV-1__FJ850075__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGYRGPSLRTTTVTGKTIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2695 - protein, 3292 aa, Artificial Sequence
  derived and/or modified protein sequence (wt) from DENV-1__FJ850077__SS-prME
SVTMLLMLLPTALAFHLTTRGGEPHMIVSKQERGKSLLFKTSVGVNMCTLIAMDLGELCEDTMTYKCPRITEVEPDDVDCWCNATDTWVTYGTCSQTGEHRRDKRSVALAPHVGLGLETRTETWMSSEGAWKQVQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILTQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRKLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENRIWGRKSWPINEGVMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTATVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGAERLKRMAISGDDCVVKPIDDRFATALTALNDMGKVRKDIPQWEPSKGWNDWQQVPFCSHHFHQLIMKDGRDIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2696 - protein, 3292 aa, Artificial Sequence
  derived and/or modified protein sequence (wt) from DENV-1__FJ850081__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSAEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2697 - protein, 3292 aa, Artificial Sequence
  derived and/or modified protein sequence (wt) from DENV-1__FJ850084__SS-prME
SVTMLLMLLPTALAFHLTTRGGEPHMIVSKQERGKSLLFKTSVGVNMCTLIAMDLGELCEDTMTYKCPRITEVEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGAAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILTQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSAEVDSFSLGILCVSILIEEVMRSRWSRKMLMTGTLAVFLLLIMGQLTWNDLIRLCIMVGANASDRMGMGTTYLALMATFKMRPMFAVGLLFRKLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTATVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGAERLKRMAISGDDCVVKPIDDRFATALTALNDMGKVRKDIPQWEPSKGWNDWQQVPFCSHHFHQLIMKDGRDIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2698 - protein, 3292 aa, Artificial Sequence
  derived and/or modified protein sequence (wt) from DENV-1__FJ850087__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLVVFLLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVLQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2699 - protein, 3292 aa, Artificial Sequence
  derived and/or modified protein sequence (wt) from DENV-1__FJ850090__SS-prME
SVTMLLMLLPTALAFHLTTRGGEPHMIVSKQERGKSLLFKTSVGVNMCTLIAMDLGELCEDTMTYKCPRITEVEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVIQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDANGILTQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMIIPKIYGGPTSQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRKLTSREVLLLTIGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTVITPMMRHTIENTTANISLTAIANQAAILMGLDKGWPISKMDIGVPLLALGCYSQVNPLTLTATVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWDFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKRVLDWLEKHGAERLKRMAISGDDCVVKPIDDRFATALTALNDMGKVRKDIPQWEPSKGWNDWQQVPFCSHHFHQLIMKDGRDIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2700 - protein, 3292 aa, Artificial Sequence
  derived and/or modified protein sequence (wt) from DENV-1__FJ850093__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTHLALMATFKMRPMFAVGLLFRRLTSREVLLLTIGLSLMASMELPNSLEELGDGLAMGIMMLKLLTEFQPHQLWTTLLSLTFVKTTLSLDYAWKTTAMILSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSETTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKRVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2701 - protein, 3292 aa, Artificial Sequence
  derived and/or modified protein sequence (wt) from DENV-1__GU131863__SS-prME
SVTMLLMLLPTALAFHLTTRGGEPHMIVSKQERGKSLLFKTSVGVNMCTLIAMDLGELCEDTMTYKCPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGLFTSVGKLIHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNYILLENDMKFTVVVGDINGILAQGKKMIRPQPMEHKYSWKSWGKAKIIGADIQNTTFIIDGPDTPECPDDQRAWNIWEVEDYGFGIFTTNIWLKLRDSHTQMCDHRLMSAAIKDSKAVHADMGYWIESEKNETWKLARASFIEVKTCIWPKSHTLWSNGVLESEMVIPKIYGGPISQHNYRPGYFTQTAGPWHLGKLELDFDLCEGTTVVVDEHCGYRGPSLRTTTVTGKIIHEWCCRSCTLPPLRFRGEDGCWYGMEIRPVKEKEENLVRSMVSAGSGEVDSFSLGILCVSILIEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMMLKLLTDFQPHQLWTTLLSLTFIRTSLSLDYAWKTMAMALSIVSLFPLCLSTTSQKTTWLPVLLGSFGCKPLTMFLITENKIWGRKSWPINEGIMAVGIVSILLSSLLKNDVPLAGPLIAGGMLIACYVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKATQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVTIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKKSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELETPNLAKKVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2702 - protein, 3292 aa, Artificial Sequence
  derived and/or modified protein sequence (wt) from DENV-1__GQ868559__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEEANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2703 - protein, 3292 aa, Artificial Sequence
  derived and/or modified protein sequence (wt) from DENV-1__GQ868560__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASIKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEEANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYIDYMTSMKRFKNESDPEGALW

SEQ ID NO: 2704 - protein, 3292 aa, Artificial Sequence
  derived and/or modified protein sequence (wt) from DENV-1__GQ868561__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPSPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQTKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2705 - protein, 3292 aa, Artificial Sequence
  derived and/or modified protein sequence (wt) from DENV-1__GU131948__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREILLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGIFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDTPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2706 - protein, 3292 aa, Artificial Sequence
  derived and/or modified protein sequence (wt) from DENV-1__GQ868562__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQHENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTHLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGATLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLKGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2707 - protein, 3292 aa, Artificial Sequence
  derived and/or modified protein sequence (wt) from DENV-1__GQ868563__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNATFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGLWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYAAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVPNLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2708 - protein, 3292 aa, Artificial Sequence
  derived and/or modified protein sequence (wt) from DENV-1__GQ868564__SS-prME
SVTMLLMLLPTALAFHLTTRGGEPHMIVSKQERGKALLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEREENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEHEAEHSGASHNILVEVQDDGTMKIKDEERDDTLTILLKAALLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2709 - protein, 3292 aa, Artificial Sequence
  derived and/or modified protein sequence (wt) from DENV-1__GQ868565__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNATFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGLWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYAAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2710 - protein, 3292 aa, Artificial Sequence
  derived and/or modified protein sequence (wt) from DENV-1__GQ868568__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWIMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADTQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2711 - protein, 3292 aa, Artificial Sequence
  derived and/or modified protein sequence (wt) from DENV-1__GQ868569__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVANPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNATFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGLWNMGEEVQVIAVEPGKNPRNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYAAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2712 - protein, 3292 aa, Artificial Sequence
  derived and/or modified protein sequence (wt) from DENV-1__GQ868570__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKVGIGILLTWLGLNSRSTSLSMTCIAVGMVTLYLGVMVQADLGCVINWKGRELKCGSGIFVTNEVHTWTEQYKFQADSPKRLSAAIGKAWEEGVCGIRSVTRLENIMWKQISNELNHILLENDMKFTVVVGDANGILAQGKKMIRPQPMEHKYSWKSWGKAKIIGADTQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDKQRTPQDNQLAYVVIGLLFMILAVAANEMGLLETTKKDLGIGYVATENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFAAALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2713 - protein, 3292 aa, Artificial Sequence
  derived and/or modified protein sequence (wt) from DENV-1__KJ189302__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPSPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2714 - protein, 3292 aa, Artificial Sequence
  derived and/or modified protein sequence (wt) from DENV-1__KJ189303__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHVIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADTQNTTFIIDGPDTPECPDGQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWNDLTRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFVKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAVDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGYVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVEWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2715 - protein, 3292 aa, Artificial Sequence
  derived and/or modified protein sequence (wt) from DENV-1__KR028435__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVICTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAISGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEEGGISERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLYSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFIDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2716 - protein, 3292 aa, Artificial Sequence
  derived and/or modified protein sequence (wt) from DENV-1__JQ922548__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHTIGTSITQKGIIFILLMLVTPSMAMRCVGIGNRDFVEGLSGATWVDVVLEHGSCVTTMARNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPMSEIQLTDYGALTLDCSPRTGLDFNEMVLLTMKEKSWLVHKQWFLDLPLPWTSGASTSQETWNRQDLLVTFKTAQAKKQEVVVLGSQEGAMHTALTGATEIQTSGTTTMFAGHLKCRLKMDKLTLKGASYVMCTGPFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGAFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILTQGKKMIRPQPMEHKYSWKSWGKAKIIGADAQNTTFIIDGPDTPECPDDQRAWNIWEVEDYGFGIFTTNIWLKLRDSYTQMCDHRLMSAAIKDSKAVHADMGYWIESEKNETWKLTRASFIEVKTCTWPRSHTLWSNGVLESEMIIPKIYGGPISQHNYRPGYFTQTAGPWHLGKLELDFNLCEGTTVVVDEHCGNGGASLGTTTVTGKIIHEWCCRSCTLPPLRFLGEDGCWYGMEIRPVKEKEENLFRSMVSAGSGEVDSFSLGLLCVSIMIEEVMRSRWSRKMLMTGTLAVFFLLIMGQLTWNDLIRLCIMVGANASDRIGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTIAMVLSIVSLFPLCLSTTSQKTTWLPVLLGSFGSKPLTMFLITENKIWGRKSWPLNEGIMAVGIVSILLSSLPKNDVPLAGPLIAGGMLIACYVISGSSADLSLERAAEVSWEEEAEHSGASHNILVEVQDDGNMKIKDEERDDSLTILLKATLLAVSGVYPMSIPATLFVWYFWQKKKQRSGVLWDTPSPPEVVRAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHANFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANSRTDRVIDPRRCLKPVILKDGPERVILAGPMPVTAASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFFLKELLIPDADGQRTPQDNQLAYVVIGLLFMILTVAANEMGLLETTKKNLGIGHVVAENHHHATMLDIDLHPASAWTLYAVATTIITPMMRHTIENTTANISLTAIANQAAILMGLDKGRPISKMDIGVPLLALGCYSQVNPLTLTAAVLMLVAHYAIIGPGLQAKATREAQKRTAAGLMKNPTVDGIAAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCATGNIVSAVNMTSRMLLNRFTMAHRKPTYERDVDLGAGTRHVAVEPEIANLDIIGQRIENIKNEHKSTWHYDEDNPYKTWAYHGTYEVKPSGSASSMVNGVVRLLTKPWDVIPMVTQIAMTDTTPFGQQRVFKEKVDTRTPRPKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFSPSELENSNLAERALDWLEKHGVERLKRMAISGDDCVVKPTDDRFATALTALNDMGKVRKDIPQCEPSKGWNDWQQVPFCSHHFHQLIMKDGREIVVPCRNQDELVGRARVSQGAGWSLRETACLGKSYAQMWQLMYFHRRDLRLAANAICSAVPVNWVPTSRTTWSIHAHHQWMTTEDMLSVWNRVWIEENPWMEDKTHVSSWADVPYLGKREDQWCGSLIGLAARATWATNIQVALNQVRRLIGNENYLDYMTSMKRFKNESDPEGALW

SEQ ID NO: 2717 - protein, 3292 aa, Artificial Sequence
  derived and/or modified protein sequence (wt) from DENV-1__JQ922544__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSCEGAWKQIQKVEIWALRHPGFTVIALFLAHAIGTSITQKGIIFILLMLVTPSMAMRCVGIGNREFVEGLSGATWVDVVLEHGSCLHTMAQNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTTHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGVTQNGRLITANPIVTDKEKPVNIEAEPPFGESYIVVGAGEKALKLSWFKKGSSIGKMFEATARGARRMAILGDTAWDFGSIGGVFTSVGKLVHQVFGTAYGVLFSGVSWIMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVEEHCGNRGPSLRTTTVTGKIIHEWCCRSCTLPPLRFKGEDGCWYGMEIRPVKEKEENLVRSMVSAGSGEVDSFSLGLLCVSIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLFPLCLSTTSQKTTWLPVLLGSFGCKPLTMFLITENKIWGRKSWPLNEGIMAVGIVSILLSSLLKNDVPLAGPLIAGGMLISFFVISGSSADLSLEKAAEVSWEEEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVNMGQPLNNDEDHAHWTEAKMLLDNINTPEGIIPALFEPERKKSAAVDGEYRLRGEARKTFVELMRRGDLPVWLSYKVASEGFQYSDRRWCFDGERNNQVLEENMDVEIWTKERERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVMASSALLWMASVEPHWIAASIILEFFLMVLLIPEPDRQRTPQDNQLAYVVIGLLFMILTVAANEMGLLETTKKDLGIGHVAAENHHHATMLDVDLRPASAWTLYAVATTIITPMMRHTIENTTANISLTAIANQAAILMGLDKGWPISLMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTAQIMEVTAKWLWGFLSRNKKPRICTREEFTRKVRSNAAMGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDKLVGRARVSQGAGWSLRETACLGKSYAQMWQLMYFHRRDLRLAANAICSAVPVDWVPTSRTTWSIHAHHQWMTTEDMLSVWNKVWIEENPWMEDKTHVSSWEDVPYLGKREDQWCGSLIGLTARATWATNIQVAINQVRRLIGNENYLDYMTSMKRFKNESDPEGALW

SEQ ID NO: 2718 - protein, 3292 aa, Artificial Sequence
  derived and/or modified protein sequence (wt) from DENV-1__JQ922546__SS-prME
SVAMLLMLLPTALAFHLTTRGGEPHMIVSKQERGKSLLFKTSAGVNMCTLIAMDLGELCEDTMTYKWPRITEAEPDDVDCWCNATDTWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIAIITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSIQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENVMWKQISNELNHILLENDMKFTVVVGDVNGILAQGKKMIRPQPMEHKYSWKSWGKAKIIGADIQNTTFIIDGPDTPECPDDQRAWNIWEVEDYGFGIFTTNIWLKLRDSYTQVCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVRSMVSAGSGEVDSFSLGLLCVSIMIEEVMRSRWSRKMLMTGTLAVFFLLIMGQLTWNDLFRLCIMVGANASDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTMAMVLSIVSLSPLCLSTTSQKTTWLPVLLGSFGCKPLTMFLITENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKASLLAVSGVYPMSIPATLFVWYFWQKKKQRSGVLWDTPSPPEVERAVLDDGIYRILQRGLLGRSQVGVGIFQDGVFHTMWHVTRGAVLMYQGKRLEPSWASVKKDLISYGGGWRFQGSWNTGEEVQVIAVEPGKNPKNVQTTPGIFKTPEGEVGAITLDFKPGTSGSPIVNREGKIVGLYGNGVVTTSGTYVSAIAQAKASQEGPLPEIEDEVFRKRNLTIMDLHPGSGKTRRYLPAIVREAMKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKEGPERVILAGPMPVTVASAAQRRGRIGRNQNKEGDQYVYMGQPLNNDEDHAHWTEAKMLLDHINTPEGIIPALFEPEREKSAAIDGEYRLRGEARKTFVELMRRGDLPVWLSYKVASEGFQYTDRRWCFDGERNNQVLEENMDVEIWMEEGEKKKIRPRWLEIEKYSDPLALREFKEFSAKRKSVLGDLKLEIGKLPQHLTIKARNALDNLVMLHNSEQGGKAYRHAMEELPDTIETLMRLGLIAVMTGGVTLFFLSGKGLGKTSNGLLCVMASSVLLWMASVEPHWIAASIILEFFLMVLLIPEPDRQRTPQDNQLAYVVIGLLFMILTVAANEMGLLETTKKDLGIGHVVAENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAPQIMKNQIVDGIVAVDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPTVTQIAMTDTTPFGQQRVFKEKVDTRTPKAKRGTAQIMEVTANWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKSGTVMDVISRRDQRGSGQVGTYGLNTFTNMEVQLIRQMESEGIFLPSELETPNLAERVLNWLEKHGVERLKRMAISGDDCVVKPTDDRFATALTALNDMGKVRKDTPQWEPSKGWNDWQQVPFCSHHFHQLIMKDGREIVVPCRNQDELVGRARVSHGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSIIGLTARATWATNIQVAINQVRRLIGNENYLDYMTSMKRFKNESDPEGALW

SEQ ID NO: 2719 - protein, 3292 aa, Artificial Sequence
  derived and/or modified protein sequence (wt) from DENV-1__JQ922545__SS-prME
SVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWRQIQKVETWALRHPGFTVIALFLAHTIGTSITQKGIIFILLMTGAPIMAMRCVGIGNRDFVEGLSGAPWVDVVLEHGSCLSNMAKNKPTLDIDFFKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQMSGTTTIFAGHLKCRLKMDKLTLKGVSYVMCTGSFKLEKEVAETQHGTVLVQVKYEGTDAPCKIPFSTQDEKGVTQNGRLITANPIVTDKEKPVNIETEPPFGESYIVIGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATCLENIMWKQISNELNHILLENDMKFTVVVGDANGILTQGKKMIRPQPMEHKYSWKSWGKAKIIGADIQNTTFIIDGPDTPECPDDQRAWNIWEVEDYGFGIFTTNIWLKLRDSYTQMCDHRLMSAAIKDSKAVHADMGYWIESEKNETWKLARASFIEVKTCIWPRSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVRSMVSAGSGEVDSFSLGLLCVSIMIEEVMRSRWSRKMLMTGTLAVFFLLIMGQLTWNDLIRLCIMVGANVSDRMGMGTTYLALMATFKMRPMFAVGLLFRRLTSREVLLLTIGLSLVASVELPNSLEELGDGLAMGIMMLKLLTDFQSHQLWTTLLSLTFIKTTLSLDYAWKTIAMVLSIVSLFPLCLSTTSQKTTWLPVLLGSFGCKPLTMFLITENKIWGRKSWPLNEGIMAVGIVSILLSSLLKNDVPLAGPLIAGGMLIACYVISGSSADLSLEKAAEVSWEEEAQHSGASHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGSDIATVLERSREPVIQLSRKTFDTEYQKTKNNDWDYVVTTDISEMGANFRADRVIDPRRCLKPVIPKDGPERVILAGPMPVTVASAAQRRGRIGRNQNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIEKLPQHLTLRAQNALDNLVMLHNSEQGGKAYRHAMEELPDTIETLMLLALIAVLTGGVTLFFLSGKGLGKTSIGLLCVMASSVLLWMASVEPHWIAASIILEFILMVLLIPEPDRQRTPQDNQLAYVVIGLLFMILTVAANEMGLLETTKKDLGIGHVVAENHHHATMLDIDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFTPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEIANLDIIGQRIENIKIGHKSTWHYDEDNPYKTWAYHGSYEVKPSGSASSMVNGVVRLLTKPWDVIPMVTQIAMTDTTPFGQQRVFKEKVDTRTPRPKRGTAQIMEVTAKWMWGFLFRNRPPRICTRDEFARKVRSSTANGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDSSNEAKIIELMRPEHALLATSIFKLTFQISVVRVQRPAKSGTVMECISRRDQKRSGQVGTYGLNTFTNMEVQLIRQMESEGIFSPSEMENSNLAERVLDWLEKHGVERLKRMAISGDDCVVKPTDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEDVPYLGKREDQWCGSLIGLTARATWATNIQVAINQVRRLIGNENYLDYMTSMKRFKNESDPEGALW

SEQ ID NO: 2720 - protein, 3292 aa, Artificial Sequence
  derived and/or modified protein sequence (wt) from DENV-1__GU131887__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIRYEGTDAPCKIPFSTQDERGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAALTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEITKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2721 - protein, 3292 aa, Artificial Sequence
  derived and/or modified protein sequence (wt) from DENV-1__GU131888__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSESAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTGWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGPMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNALIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2722 - protein, 3292 aa, Artificial Sequence
  derived and/or modified protein sequence (wt) from DENV-1__GU131892__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2723 - protein, 3292 aa, Artificial Sequence
  derived and/or modified protein sequence (wt) from DENV-1__GU131893__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGATQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGLGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSHTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRSHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLVWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2724 - protein, 3292 aa, Artificial Sequence
  derived and/or modified protein sequence (wt) from DENV-1__GU131894__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWTPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2725 - protein, 3292 aa, Artificial Sequence
  derived and/or modified protein sequence (wt) from DENV-1__GU131895__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLALKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2726 - protein, 3292 aa, Artificial Sequence
  derived and/or modified protein sequence (wt) from DENV-1__GQ868632__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDEQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEREENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSFLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2727 - protein, 3292 aa, Artificial Sequence
  derived and/or modified protein sequence (wt) from DENV-1__GQ868633__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEATKHAVSRGPAKLRWFVERNLVNPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWVSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFWSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2728 - protein, 3292 aa, Artificial Sequence
  derived and/or modified protein sequence (wt) from DENV-1__GU131919__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFLTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANACDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2729 - protein, 3292 aa, Artificial Sequence
  derived and/or modified protein sequence (wt) from DENV-1__GU131920__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDREKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRRLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2730 - protein, 3292 aa, Artificial Sequence
  derived and/or modified protein sequence (wt) from DENV-1__GU131921__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVMALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPMTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGAAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVEKAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2731 - protein, 3292 aa, Artificial Sequence
  derived and/or modified protein sequence (wt) from DENV-1__GQ868635__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVMALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGAAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVEKAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2732 - protein, 3292 aa, Artificial Sequence
  derived and/or modified protein sequence (wt) from DENV-1__GQ868636__SS-prME
SVTMLLMLMPTALAFHLTTRGGEPHMIVTKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLMEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGLGEVDSFSLGLLCISIMIEEVMRSRWSRKMLMAGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTLSLHHAWKTMAMVLSIVSLFPLCLSTTSQKTTWLPVLLGSLGCKPLTMFLIAENKIWGRKSWPLNEGIMAVGVVSILLSSLLKNDVPLAGPLIAGGMLIACYVISGSSADLSLEKAAEVSWEEEAEHSGASHNILVEVQDDGTMKIKDEERDDTLTILLKATLLAISGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNIYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFTPPERCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVQKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFLPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWGDVPYLGKREDQWCGSLIGLTARATWASNIQVAINQVRRLIGNENYLDYMTSMKRFKNEGDPEGALW

SEQ ID NO: 2733 - protein, 3292 aa, Artificial Sequence
  derived and/or modified protein sequence (wt) from DENV-1__GU131922__SS-prME
SVIMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2734 - protein, 3292 aa, Artificial Sequence
  derived and/or modified protein sequence (wt) from DENV-1__GU131923__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTVVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGITQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGKRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHEAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2735 - protein, 3292 aa, Artificial Sequence
  derived and/or modified protein sequence (wt) from DENV-1__GQ868637__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEREENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLIAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIDENPWMEDKTHISSWGDVPYLGKREDQWCGSLIGLTARATWATNIQVAINQVRRLIGNENYLDYMTSMKRFKNESDPEGALW

SEQ ID NO: 2736 - protein, 3292 aa, Artificial Sequence
  derived and/or modified protein sequence (wt) from DENV-1__GQ868639__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLADFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSAEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2737 - protein, 3292 aa, Artificial Sequence
  derived and/or modified protein sequence (wt) from DENV-1__GU131925__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2738 - protein, 3292 aa, Artificial Sequence
  derived and/or modified protein sequence (wt) from DENV-1__GU131926__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGVNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSAEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2739 - protein, 3292 aa, Artificial Sequence
  derived and/or modified protein sequence (wt) from DENV-1__FJ639669__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2740 - protein, 3293 aa, Artificial Sequence
  derived and/or modified protein sequence (wt) from DENV-1__FJ639670__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGVSRKNLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWIASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSSNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2741 - protein, 3292 aa, Artificial Sequence
  derived and/or modified protein sequence (wt) from DENV-1__FJ639671__SS-prME
SVTMLLMLMPTALAFHLTTRGGEPHMIVSKQERGKSLLFKTSAGVNMCTLIAMDLGELCEDTLTYKCPRITEVEPDDVDCWCNTTDTWVTYGTCSQTGEHRRDKRSVALAPHVGLGLETRAETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDGKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENVMWRQISNELNHILLENDMKFTVVVGDVVGILAQGKKMIRPQPMEHKYSWKSWGKAKIIGADVQNTTFIIDGPNTSECPDDQRAWNIWEVEDYGFGIFTTNIWLKLRDSYTQVCDHRLMSAAIKDSRAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPETIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2742 - protein, 3292 aa, Artificial Sequence
  derived and/or modified protein sequence (wt) from DENV-1__JN819423__SS-prME
SVTMLLMLMPTALAFHLTTRGGEPHMIVSKQERGKSLLFKTSAGVNMCTLIAMDLGELCEDTLTYKCPRITEVEPDDVDCWCNTTDTWVTYGTCSQTGEHRRDKRSVALAPHVGLGLETRAETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDGKGVTQNGRLITANPIVTDKEKPVNIEAEPPFGESYIVIGAGEKALKLSWFKKGSSIGKMFEATARGARRMAILGDTAWDFGSVGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENVMWRQISNELNHILLENDMKFTVVVGDVVGILAQGKKMIRPQPMEHKYSWKSWGKAKIIGADVQNTTFIIDGPNTSECPDDQRAWNIWEVEDYGFGIFTTNIWLKLRDSYTQVCDHRLMSAAIKDSRAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPETIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHQQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2743 - protein, 3292 aa, Artificial Sequence
  derived and/or modified protein sequence (wt) from DENV-1__FJ639672__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGISSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDAFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2744 - protein, 3292 aa, Artificial Sequence
  derived and/or modified protein sequence (wt) from DENV-1__FJ639673__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRSCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAVVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2745 - protein, 3292 aa, Artificial Sequence
  derived and/or modified protein sequence (wt) from DENV-1__FJ639674__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSMSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPVKNGTVMDVISRRDQRGSGQVGTYGLNTFTNMEAQLIRQMESEGIFSPSELETPNLAGRVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2746 - protein, 3292 aa, Artificial Sequence
  derived and/or modified protein sequence (wt) from DENV-1__FJ639675__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGLFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSSAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2747 - protein, 3292 aa, Artificial Sequence
  derived and/or modified protein sequence (wt) from DENV-1__FJ639676__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHAGLGLETRAETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIVGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFFIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGILEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDFMTSMKRFKNESDTEGALW

SEQ ID NO: 2748 - protein, 3292 aa, Artificial Sequence
  derived and/or modified protein sequence (wt) from DENV-1__FJ639677__SS-prME
SVTMLLMLMPTALAFHLTTRGGEPHMIVSKQERGKSLLFKTSAGVNMCTLIAMDLGELCEDTMTYKCPRVTEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAMGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLKGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRSKKPRICTREEFIRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2749 - protein, 3292 aa, Artificial Sequence
  derived and/or modified protein sequence (wt) from DENV-1__GQ868618__SS-prME
SVTMLLMLMPTALAFHLTTRGGEPHMIVSKQERGKSLLFKTSAGVNMCTLIAMDLGEFCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2750 - protein, 3292 aa, Artificial Sequence
  derived and/or modified protein sequence (wt) from DENV-1__GQ868619__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLVVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPIILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVMLFFLSGRGLGKTSIGLLCVMASSGLLWMASVEPHWIAASIILEFFLMVLLIPEPDRQRTPQDNQLAYVVMGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2751 - protein, 3292 aa, Artificial Sequence
  derived and/or modified protein sequence (wt) from DENV-1__FJ639678__SS-prME
SVTMLLMLMPTALAFHLTTRGGEPHMIVSKQERGKALLFKTSAGVNMCTLIAMDLGELCEDTMTYKCPRITEVEPDDVDCWCNATDTWVTYGTCPQTGEHRRDRRSVALAPHVGLGLETRAETWMSSEGAWKQIQRVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVVGILAQGKKMIRPQPMEYKYSWKSWGKAKIIGADIQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLLPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFLWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGQERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQKAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTRHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKQGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLRNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2752 - protein, 3292 aa, Artificial Sequence
  derived and/or modified protein sequence (wt) from DENV-1__FJ639679__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAARVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2753 - protein, 3292 aa, Artificial Sequence
  derived and/or modified protein sequence (wt) from DENV-1__FJ850069__SS-prME
SVTMLLMLMPTALAFHLTTRGGEPHMIVGKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWVTLLSLTFIKTTFSLHYAWKTMAMVLSIVSLLPLCLSTTSQKTTWLPVLLGSLGCKPLTMFFIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGILEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAGWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDTEGALW

SEQ ID NO: 2754 - protein, 3292 aa, Artificial Sequence
  derived and/or modified protein sequence (wt) from DENV-1__FJ639680__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHNHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2755 - protein, 3292 aa, Artificial Sequence
  derived and/or modified protein sequence (wt) from DENV-1__FJ639682__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKTLKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKLTVVVGDVAGILAQGKKMIRPQPMEYKYSWKSWGKAKIIGADAQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVLSGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGIPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGTGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKAIFKLTYQNKVVRVQRPAKNGTVMDVISRRDQRGSGQVGTYGLNTFTNMEAQLIRQMESEGIFSPSELETPNLAERALDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2756 - protein, 3292 aa, Artificial Sequence
  derived and/or modified protein sequence (wt) from DENV-1__JQ287664__SS-prME
SVTMLLMLMPTALAFHLTTRGGEPHMIVSKQERGKSLLFKTSAGVNMCTLIAMDLGELCEDTMTYKCPRITEVEPDDVDCWCNTTDTWVTYGTCSQTGEHRRDKRSVALAPHVGLGLETRAETWMSSEGAWKQIQRVETWALRHPGFTVIALFLAHVIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWRQISNELNHILLENDMKFTVVVGDVVGILAQGKKMIRPQPMEHKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLLPLCLSTTSQKTTWLPVLLGSLGCKPLTMFFIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRKYLPAIVREAIKRKLRTLILAPTRVVASEMAEALKGMPIRYQTTAVKSEHTGREIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTQRAQNALDNLVMLHNSEQGGRAYRHAMEELPDTIETLMLLALIAVLTGGVTLFFLSGRGLGKTSIGLLCVMASSALLWMASVEPHWIAASIILEFFLMVLLIPEPDRQRTPQDNQLAYVVIGLLFMILTVAANEMGLLETTKKDLGIGHVAVENHHHATMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGILEVDRSEAKEGLRRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPFDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDTEGALW

SEQ ID NO: 2757 - protein, 3292 aa, Artificial Sequence
  derived and/or modified protein sequence (wt) from DENV-1__FJ639683__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSLVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGHEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2758 - protein, 3292 aa, Artificial Sequence
  derived and/or modified protein sequence (wt) from DENV-1__FJ639684__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESVPEGALW

SEQ ID NO: 2759 - protein, 3292 aa, Artificial Sequence
  derived and/or modified protein sequence (wt) from DENV-1__FJ639685__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAAGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSVMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPILAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2760 - protein, 3292 aa, Artificial Sequence
  derived and/or modified protein sequence (wt) from DENV-1__FJ639686__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIRYEGTDAPCKIPFSTQDERGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEITKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2761 - protein, 3292 aa, Artificial Sequence
  derived and/or modified protein sequence (wt) from DENV-1__FJ639687__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSAEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLKETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2762 - protein, 3292 aa, Artificial Sequence
  derived and/or modified protein sequence (wt) from DENV-1__FJ639688__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNVWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPTSLEELGDGLAMGIMILKLLTDFQSHQLWATLLSLTFIKTTFSLHYAWKTMAMVLSIVSLLPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAAENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQMAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAIYQVRRLIGNENYLDYMTSMKRFKNESDPEGALW

SEQ ID NO: 2763 - protein, 3292 aa, Artificial Sequence
  derived and/or modified protein sequence (wt) from DENV-1__FJ639689__SS-prME
SVTMLLMLMPTALAFHLTIRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMTEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMILKLLTDFQPHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGVMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEITKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2764 - protein, 3292 aa, Artificial Sequence
  derived and/or modified protein sequence (wt) from DENV-1__FJ639690__SS-prME
SVTMLLMLMPTALAFHLTIRGGEPHMIVSKQERGKSLLFKTSAGVNMCTLIAMDLGELCEDTMTYKCPRITEAEPDDVDCWCNATDTWVTYGTCSQIGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCVWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMTEEVMRSRWSRKMLMTGTLAVFLLLIMGQLTWNDLIRLCIMVGANASDRMGMGTTYLALMATFKMRPMFAVGLLFRRLTSREVLLLTVGLSLVASVELPNSLEELGDGLAMGIMILKLLTDFQPHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEITKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2765 - protein, 3292 aa, Artificial Sequence
  derived and/or modified protein sequence (wt) from DENV-1__FJ639691__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERTLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDLEGALW

SEQ ID NO: 2766 - protein, 3292 aa, Artificial Sequence
  derived and/or modified protein sequence (wt) from DENV-1__FJ639692__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSESAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNALIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGITEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2767 - protein, 3292 aa, Artificial Sequence
  derived and/or modified protein sequence (wt) from DENV-1__FJ639693__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSAEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLAVGFQTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAGPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2768 - protein, 3292 aa, Artificial Sequence
  derived and/or modified protein sequence (wt) from DENV-1__FJ639694__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGEITKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISNWGDVPYLGKREDQWCGSLIGLTARATWATNIQVAINQVRRLIGNENYLDYMTSMKRFKNESDPEGALW

SEQ ID NO: 2769 - protein, 3292 aa, Artificial Sequence
  derived and/or modified protein sequence (wt) from DENV-1__FJ639695__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLMTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGLGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRSHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLVWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2770 - protein, 3292 aa, Artificial Sequence
  derived and/or modified protein sequence (wt) from DENV-1__FJ639696__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPSELETPNLAERALDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDLEGALW

SEQ ID NO: 2771 - protein, 3292 aa, Artificial Sequence
  derived and/or modified protein sequence (wt) from DENV-1__HM181937__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNIEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2772 - protein, 3292 aa, Artificial Sequence
  derived and/or modified protein sequence (wt) from DENV-1__HM181939__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAINMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLANSIFKLTYQNKVVRVQRPAKNGTVMDVISRRDQRGSGQVGTYGLNTFTNMEAQLIRQMESEGIFSPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2773 - protein, 3292 aa, Artificial Sequence
  derived and/or modified protein sequence (wt) from DENV-1__HM181942__SS-prME
SVTMLLMLMPTALAFHLTTRGGEPHMIVSKQERGKSLLFKTSAGVNMCTLIAMDLGEFCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLANSIFKLTYQNKVVRVQRPAKNGTVMDVISRRDQRGSGQVGTYGLNTFTNMEAQLIRQMESEGIFSPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2774 - protein, 3292 aa, Artificial Sequence
  derived and/or modified protein sequence (wt) from DENV-1__HM488255__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSESAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGRGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2775 - protein, 3292 aa, Artificial Sequence
  derived and/or modified protein sequence (wt) from DENV-1__HM181944__SS-prME
SVTMLLMLMPTALAFHLTTRGGEPHMIVSKQERGKSLLFKTSAGVNMCTLIAMDLGELCEDTMTYKCPRISEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPSTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFKGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGMTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTSEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKISGGNMYADDTAGWDTRITEDDLQNEAKITDIMEPEHALLANSIFKLTYQNKVVRVQRPAKNGTVMDVISRRDQRGSGQVGTYGLNTFTNMEAQLIRQMESEGIFSPSELETPNLAERVLDWLEKHGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWEDVPYLGKREDQWCGSLIGLTARATWATNIQVAINQVRRLIGNENYLDYMTSMKRFKNESDPEGALW

SEQ ID NO: 2776 - protein, 3292 aa, Artificial Sequence
  derived and/or modified protein sequence (wt) from DENV-1__HM181946__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIRYEGTDAPCKIPFSTQDERGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSFSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWRSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFVPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2777 - protein, 3292 aa, Artificial Sequence
  derived and/or modified protein sequence (wt) from DENV-1__HM181948__SS-prME
SVTMLLMLMPTALAFHLTTRGGEPHMIVSKQERGKSLLFKTSAGVNMCTLIAMDLGELCEDTMTYKCPRITEVEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2778 - protein, 3292 aa, Artificial Sequence
  derived and/or modified protein sequence (wt) from DENV-1__HM181949__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTGHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGRGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2779 - protein, 3292 aa, Artificial Sequence
  derived and/or modified protein sequence (wt) from DENV-1__HM181950__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGAAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYSLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2780 - protein, 3292 aa, Artificial Sequence
  derived and/or modified protein sequence (wt) from DENV-1__HM181952__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNSTFIIDGPNTPECPDDQRAWNIWEVEDYGFGIFTTNIWLKLRDSYTQVCDHRLMSAAIKDSKAVHADMGYWIESEKNETWKLAKASFIEVKTCIWPKSHTLWSNGVLESEMIIPKIHGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWHFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSMEAFPQSNAVIQDEERDIPERSWNSGYEWITDFPGKTVWFVPSIKAGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGKGLGKTSIGLLCVMASSVLLWMASVEPHWIAASIILEFFLMVLLIPEPDRQRTPQDNQLAYVVIGLLFMILTVAANEMGLLETTKKDLGIGHVAVENHHHAAMLDVDLHPASAWTLYAVATTIITPMMRHTIENTTANISLTAIANQAAILMGLDKGWPISKMDIGVPLLALGCYSQVNPLTLTAAVLMLVAHYAIVGPGLQAKATREAQKRTAAGIMKNPTIDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTARWLWGFLSRNKKPRICTREEFTRKVRSNAAIGAVFVDENQWNSAKEAVEDDRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFLPNELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTRISSWEDVPYLGKREDQWCGSLIGLTARATWATNIQVAINQVRRLIGNENYSDYMTSMKRFKNESEPEGALW

SEQ ID NO: 2781 - protein, 3292 aa, Artificial Sequence
  derived and/or modified protein sequence (wt) from DENV-1__HM181953__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILVQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKLEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2782 - protein, 3292 aa, Artificial Sequence
  derived and/or modified protein sequence (wt) from DENV-1__KF921933__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSKCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRLGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDGRFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2783 - protein, 3292 aa, Artificial Sequence
  derived and/or modified protein sequence (wt) from DENV-1__HM181954__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTPGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGAAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQACDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2784 - protein, 3292 aa, Artificial Sequence
  derived and/or modified protein sequence (wt) from DENV-1__HM181955__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSESAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLVVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2785 - protein, 3292 aa, Artificial Sequence
  derived and/or modified protein sequence (wt) from DENV-1__HM181959__SS-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSESAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKVIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLVVFLLLIMGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPEGALW

SEQ ID NO: 2786 - protein, 3292 aa, Artificial Sequence
  derived and/or modified protein sequence (wt) from DENV-1__JF937651__SS-prME
SVTMLLMLMPTALAFHLTTRGGEPHMILSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAILRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLIHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVAGILAQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFLLLIMGQLTWNDLIRLCIMVGANACDRMGMGTTYLALMATFKMRPMFAVGLLFRRLTSREVLLLTIGLSLVASVELPNSLEELGDGLAMGIMILKLLTDFQSYQLWATLLSLTFIKTTFSLHYAWKTMAMVLSIVSLFPLCLSTTSQKTTWLPVLLGSLGCKPLTMFLIAENKIWGRRSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAVGNHHHAAMLDVDLHPASAWTLYAVATTIITPMMKHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTGKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEARITDIMEPEHALLAKSIFKLTYQNKVVRVQRPAKNGTVMDVISRRDQRGSGQVGTYGLNTFTNMEAQLIRQMESEGIFSPSELETPNLAERVLDWLEKYGVERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWIPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESDPKGALW

SEQ ID NO: 2787 - protein, 3292 aa, Artificial Sequence
  derived and/or modified protein sequence (wt) from DENV-1__GU131956__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGTIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2788 - protein, 3292 aa, Artificial Sequence
  derived and/or modified protein sequence (wt) from DENV-1__GU131958__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2789 - protein, 3292 aa, Artificial Sequence
  derived and/or modified protein sequence (wt) from DENV-1__GQ868499__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGGHRREKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWKDLIRLCIMVGANASDRMGMGTTYLALMATFKMRPMFAVGLLFRRLTSREVLLLTIGLSLVASLELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKVAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2790 - protein, 3292 aa, Artificial Sequence
  derived and/or modified protein sequence (wt) from DENV-1__GQ868500__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFVILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVKQIAMTDTTPFGQQRVFKEKVDTRTPRAKRGTTQIMEVTAKWLWGFLSRNKKPRICTREEFTRKVRSNAAIGAVFVGENQWNSAKEAVEDERVWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2791 - protein, 3292 aa, Artificial Sequence
  derived and/or modified protein sequence (wt) from DENV-1__GU131961__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFRLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGVLW

SEQ ID NO: 2792 - protein, 3289 aa, Artificial Sequence
  derived and/or modified protein sequence (wt) from DENV-1__GU131962__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEYASAGLAIIVPLPLDTYGRNRLKIHSGKDVFFMPPEKGDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2793 - protein, 3292 aa, Artificial Sequence
  derived and/or modified protein sequence (wt) from DENV-1__GU131963__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTQVSSWEEVPYLGKREDQWCGSLIGLTARATWATNIQVAINQVRRLIGNENYLDYMTSMKRFKNESDPEGALW

SEQ ID NO: 2794 - protein, 3292 aa, Artificial Sequence
  derived and/or modified protein sequence (wt) from DENV-1__KF955442__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCDGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2795 - protein, 3292 aa, Artificial Sequence
  derived and/or modified protein sequence (wt) from DENV-1__GU131965__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWVLRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRNTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTATGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2796 - protein, 3292 aa, Artificial Sequence
  derived and/or modified protein sequence (wt) from DENV-1__GU131966__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYRRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2797 - protein, 3292 aa, Artificial Sequence
  derived and/or modified protein sequence (wt) from DENV-1__GQ868501__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENQIWGRKSWPLNEGIMAIGIVSILLSSLLKNDVPLAGPLIAGGMLIACYVISGSSADLSLEKTAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPILMATYGWNLVELHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2798 - protein, 3292 aa, Artificial Sequence
  derived and/or modified protein sequence (wt) from DENV-1__HQ166035__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIRLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATMLAVSGVYPMSIPATPFVWYFWQKKKQRIRVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREEKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2799 - protein, 3292 aa, Artificial Sequence
  derived and/or modified protein sequence (wt) from DENV-1__GQ868502__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGTIFILLMLATPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKTVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2800 - protein, 3292 aa, Artificial Sequence
  derived and/or modified protein sequence (wt) from DENV-1__GQ868503__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQNEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLERASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKRKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGIFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2801 - protein, 3292 aa, Artificial Sequence
  derived and/or modified protein sequence (wt) from DENV-1__GQ868504__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKGEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYPDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2802 - protein, 3292 aa, Artificial Sequence
  derived and/or modified protein sequence (wt) from DENV-1__GU131967__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQTCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHGEPIPLATYGWNLVKLHSGKDVFFMPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2803 - protein, 3292 aa, Artificial Sequence
  derived and/or modified protein sequence (wt) from DENV-1__GU131968__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQNEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLERASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKRKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2804 - protein, 3292 aa, Artificial Sequence
  derived and/or modified protein sequence (wt) from DENV-1__GQ868506__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPGRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2805 - protein, 3292 aa, Artificial Sequence
  derived and/or modified protein sequence (wt) from DENV-1__GQ868507__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWITLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTMPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLPSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2806 - protein, 3292 aa, Artificial Sequence
  derived and/or modified protein sequence (wt) from DENV-1__GQ868508__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWITLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTMPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2807 - protein, 3292 aa, Artificial Sequence
  derived and/or modified protein sequence (wt) from DENV-1__GQ868509__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQMSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSVTRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFLWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2808 - protein, 3292 aa, Artificial Sequence
  derived and/or modified protein sequence (wt) from DENV-1__GQ868510__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGGHRREKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDIQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWKDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSLGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLGKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2809 - protein, 3292 aa, Artificial Sequence
  derived and/or modified protein sequence (wt) from DENV-1__GQ868511__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLTCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKKKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNAYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDESFWDLVHKERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMGVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2810 - protein, 3292 aa, Artificial Sequence
  derived and/or modified protein sequence (wt) from DENV-1__GQ868512__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2811 - protein, 3292 aa, Artificial Sequence
  derived and/or modified protein sequence (wt) from DENV-1__GU131970__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRREKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKTIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLIMGQLTWKDLIRLCIMVGANASDRMGMGTTYLALMATFKMRPMFAVGLLFRRLTSREVLLLTIGLSLVASVELPNSLEELGDGLAMGIMMLKLLTEFHPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLKETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2812 - protein, 3292 aa, Artificial Sequence
  derived and/or modified protein sequence (wt) from DENV-1__KF955427__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTAWTGATEIQTSGTTTIFAGHLKWRLKMDKLTLKGTSYVMCTGSFKLEKEVAETQHGTGLVQVKYEGTDAPCKIPFSAQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLPDPLIAGGILIACYVISGSSADLSLEKAAEMSWEQEAEHSGTSHNILVEVQDDGPMKIKDEERDDTLTILLKATLLAVSGVYPMSIPGTLFVWYFWQKKKQRSGVLWDTPSPPKVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSISGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2813 - protein, 3292 aa, Artificial Sequence
  derived and/or modified protein sequence (wt) from DENV-1__GQ868513__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMPTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWITLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTMPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2814 - protein, 3292 aa, Artificial Sequence
  derived and/or modified protein sequence (wt) from DENV-1__GU131973__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKMRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2815 - protein, 3292 aa, Artificial Sequence
  derived and/or modified protein sequence (wt) from DENV-1__GQ868517__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMVLSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2816 - protein, 3292 aa, Artificial Sequence
  derived and/or modified protein sequence (wt) from DENV-1__GU131976__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASLMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLKAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGTERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2817 - protein, 3292 aa, Artificial Sequence
  derived and/or modified protein sequence (wt) from DENV-1__GQ868518__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGPSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFRGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTSRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2818 - protein, 3292 aa, Artificial Sequence
  derived and/or modified protein sequence (wt) from DENV-1__GQ868519__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFLTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWITLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTMPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2819 - protein, 3292 aa, Artificial Sequence
  derived and/or modified protein sequence (wt) from DENV-1__KF955443__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQMSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSVTRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLIMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFLWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWTLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTFERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2820 - protein, 3292 aa, Artificial Sequence
  derived and/or modified protein sequence (wt) from DENV-1__GQ868520__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTMPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2821 - protein, 3292 aa, Artificial Sequence
  derived and/or modified protein sequence (wt) from DENV-1__GQ868522__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWITLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTMPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQAPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2822 - protein, 3292 aa, Artificial Sequence
  derived and/or modified protein sequence (wt) from DENV-1__HQ166036__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFRGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTSRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2823 - protein, 3292 aa, Artificial Sequence
  derived and/or modified protein sequence (wt) from DENV-1__GU131981__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIMVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWITLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTMPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2824 - protein, 3292 aa, Artificial Sequence
  derived and/or modified protein sequence (wt) from DENV-1__GQ868529__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIAFFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKTVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQIAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLMLEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGLGHEDPIPMATYGWNLVKLLAGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2825 - protein, 3292 aa, Artificial Sequence
  derived and/or modified protein sequence (wt) from DENV-1__GQ868531__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCVSIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVEALEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAISSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2826 - protein, 3292 aa, Artificial Sequence
  derived and/or modified protein sequence (wt) from DENV-1__GU131983__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMIGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEEIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2827 - protein, 3292 aa, Artificial Sequence
  derived and/or modified protein sequence (wt) from DENV-1__GQ868532__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIGADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWITLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGNSADLSLEKAAEVSWEQEAEHSGTSHNILVEVQDDGTMKIKDEERDDTLTILLKATLLAVSGVYPMSIPATLFVWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTMPGTFKTPEGEVGAIALDFKPGTSGSPIVNREGKIVGLYGNGVVTTSGTYVSAIAQAKASQEGPPPEIEDEVFKKRNLTIMDLHPGSGKTRRYLPAMVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTLRAQNALDNLVMLHNSEQGGKAYRHAMEELPDTIETLMLLTLIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFMPPEKCDTLLCDIGESSPNPTIEEGRTLRVLKMVEPWLRGNQFCIKILNPYMPNVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKPSGSASSMVNGVVRLLTKPWDGIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW

SEQ ID NO: 2828 - protein, 3292 aa, Artificial Sequence
  derived and/or modified protein sequence (wt) from DENV-1__GQ868533__SS-prME
SVTMLLMLLPTALAFHLTTRGGEPHMIVSKQERGKSLLFKTSAGVNMCTLIAMDLGELCEDTMTYKCPQITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAILRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNETTEHGTIATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGTSYVMCTGSFKLEKEVAETQHGTVLVQVKYEGTDAPCKIPFSTQDEKGVTQNGRLITANPIVTDKEKPVNIETEPPFGESYIVVGAGEKALKLSWFKKGSSIGKMFEATARGARRMAILGDTAWDFGSIGGVFTSVGKLVHQVFGTAYGVLFSGVSWTMKIGIGILLTWLGLNSRSTSLSMTCIAVGMVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDANGILAQGKKMIRPQPMEHKYSWKSWGKAKIIEADIQNTTFIIDGPDTPECPDNQRAWNIWEVEDYGFGIFTTNIWLKLRDSYTQMCDHRLMSAAIKDSKAVHADMGYWIESEKNETWKLARASFIEVKTCTWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVRSMVSAGSGEVDSFSLGILCASIMIEEVMRSRWSRKMLMTGTLAVFLLLVMGQLTWNDLIRLCIMVGANASDRMGMGTTYLALMATFKMRPMFAVGLLFRRLTSREVLLLTIGLSLVASVELPNSLEELGDGLAMGIMMLKLLTEFQPHQLWTTLLSLTFIKTTLSLDYAWKTTAMALSIVSLFPLCLSTTSQKTTWLPVLLGSFGCKPLTMFLITENKIWGRKSWPLNEGIMAIGIVSILLSSLLKNDVPLAGPLIAGGMLIACYVISGSSADLSLEKAAEVSWEQEAEHSGTSHNILVEVQDDGTMKIKDEERDDTLTILLKATLLAVSGVYPMSIPATLFLWYFWQKKKQRSGVLWDTPSPPEVERAVLDDGIYRILQRGLLGRSQVGVGVFQDGVFHTMWHVTRGAVLMYQGKRLEPSWASVKKDLISYGGGWRFQGSWNTGEEVQVIAVEPGKNPKNVQTTPGTFKTPEGEVGAIALDFKPGTSGSPIVNREGKIVGLYGNGVVTTSGTYVSAIAQAKASQEGPLPEIEDEVFKKRNLTIMDLHPGSGKTRRYLPAIVREAIKRKLRTLILAPTRVVASEMAEALKGMPIRYQTTAVKSEHTGREIVDLMCHATFTMRLLSPVRVPNYNMIIMDEAHFTDPASIAARGYISTRVGMGEAAAIFMTATPPGSVEAFPQSNAVIQDEERDIPERSWNSGYDWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNQNKEGDQYVYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGERKKLRPRWLDARTYSDPLALREFKEFAAGRRSVSGDLILEIGKLPQHLTSRAQNALDNLVMLHNSEQGGKAYRHAMEELPDTIETLMLLALIAVLTGGVTLFFLSGKGLGKTSIGLLCVTASSALLWMASVEPHWIAASIILEFFLMVLLIPEPDRQRTPQDNQLAYVVIGLLFMILTVAANEMGLLETTKKDLGIGHVAAENHQHATMLDVDLRPASAWTLYAVATTVITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLAKLHSGKDVFFMPPEKCDTLLCDIGESSPNPTIEEGRTLRVLKMVEPWLRGNQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKNEHKSTWHYDEDNPYKTWAYHGSYEVKSSGSASSMVNGVVRLLTKPWDVIPMVTQIAMTDTTPFGQQRVFKEKVDTRTPRAKRGTTQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITEIMEPEHALLATSIFKLTYQNKVVRVQRPAKNGTVMDVISRRDQRGSGQVGTYGLNTFTNMEVQLIRQMESEGIFLPSELETPNLAERVLDWLEKHGAERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHVSSWEEVPYLGKREDQWCGSLIGLTARATWATNIQVAINQVRRLIGNENYLDYMTSMKRFKNESDPEGALW
